(12) United States Patent
Verhaegh et al.

(10) Patent No.: US 11,443,831 B2
(45) Date of Patent: *Sep. 13, 2022

(54) ASSESSMENT OF CELLULAR SIGNALING PATHWAY ACTIVITY USING PROBABILISTIC MODELING OF TARGET GENE EXPRESSION

(75) Inventors: Wilhelmus Franciscus Johannes Verhaegh, Heusden Gem. Asten (NL); Anja Van De Stolpe, Vught (NL); Hendrik Jan Van Ooijen, Wijk en Aalburg (NL); Kalyana Chakravarthi Dulla, Eindhoven (NL); Marcia Alves De Inda, Rosmalen (NL); Ralf Hoffmann, Brueggen (DE)

(73) Assignee: InnoSIGN B.V., Eindhoven (NL)

( * ) Notice: Subject to any disclaimer, the term of this patent is extended or adjusted under 35 U.S.C. 154(b) by 638 days.

This patent is subject to a terminal disclaimer.

(21) Appl. No.: 14/233,546

(22) PCT Filed: Jul. 19, 2012

(86) PCT No.: PCT/IB2012/053686
§ 371 (c)(1),
(2), (4) Date: Jan. 17, 2014

(87) PCT Pub. No.: WO2013/011479
PCT Pub. Date: Jan. 24, 2013

(65) Prior Publication Data
US 2014/0156200 A1 Jun. 5, 2014

Related U.S. Application Data

(60) Provisional application No. 61/509,137, filed on Jul. 19, 2011.

(30) Foreign Application Priority Data

Aug. 19, 2011 (EP) ...................... 1178148

(51) Int. Cl.
| | | |
|---|---|---|
| *G16B 5/20* | (2019.01) | |
| *G16B 5/00* | (2019.01) | |
| *G16B 20/00* | (2019.01) | |
| *C12Q 1/6809* | (2018.01) | |
| *C12Q 1/6886* | (2018.01) | |
| *G16B 40/00* | (2019.01) | |
| *G16B 20/30* | (2019.01) | |
| *G16B 40/20* | (2019.01) | |
| *G16B 20/20* | (2019.01) | |
| *G16B 25/00* | (2019.01) | |

(52) U.S. Cl.
CPC ............ *G16B 5/20* (2019.02); *C12Q 1/6809* (2013.01); *C12Q 1/6886* (2013.01); *G16B 5/00* (2019.02); *G16B 20/00* (2019.02); *G16B 20/20* (2019.02); *G16B 20/30* (2019.02); *G16B 40/00* (2019.02); *G16B 40/20* (2019.02); *C12Q 2600/106* (2013.01); *C12Q 2600/158* (2013.01); *G16B 25/00* (2019.02)

(58) Field of Classification Search
None
See application file for complete search history.

(56) References Cited

U.S. PATENT DOCUMENTS

| | | |
|---|---|---|
| 2004/0005313 A1 | 1/2004 | Clevers |
| 2005/0112630 A1 | 5/2005 | Shaughnessy |
| 2014/0156200 A1 | 6/2014 | Verhaegh |

FOREIGN PATENT DOCUMENTS

| | | |
|---|---|---|
| JP | 2010178650 A | 8/2010 |
| WO | 2004005457 A2 | 1/2004 |
| WO | 2004022575 A2 | 3/2004 |
| WO | 2006124836 A1 | 11/2006 |
| WO | 2007136787 A2 | 11/2007 |
| WO | 2012135845 A1 | 10/2012 |
| WO | 2012149609 A1 | 11/2012 |

OTHER PUBLICATIONS

Friedman (Science (2004) vol. 303, pp. 799-805).*
Lee et al. (PNAS (2010) vol. 107:9736-9741).*
Hecker et al. (BioSystems (2009) vol. 96).*
Klinke (BMC Bioinformatics (2009) vol. 10:e—pp. 1-18).*
Liao et al. (PNAS (2003) vol. 100:15522-15527).*
Pournara et al. (BMC Bioinformatics (2007) vol. 8:e—pp. 1-20).*
Wilczynski et al. (Bioinformatics (2009) vol. 25:286-287).*
Katoh et al. (Current Molecular Medicine (2009) vol. 9, Issue 7: 873-886).*
Chen et al. (Drug Discovery Today (2012) vol. 17:194-202).*
Lawrence, Neil D. et al "Modelling Transcriptional Regulation using Gaussian Processes", Advances in Neural Information Processing Systems 19. 2006, pp. 1-8.
Carro, Maria Stella et al "The Transcriptional Network for Mesenchymal Transformation of Brain Tumours" Nature, vol. 463, Jan. 2010, pp. 318-327.
Verhaegh, Wim et al "Selection of Personalized Patient Therapy through the use of Knowledge-Based Computational Models that Identify Tumor-Driving Signal Transduction Pathways", Integrated Systems and Technologies—Cancer Research vol. 13, 2014, pp 2936-2945.

(Continued)

*Primary Examiner* — Lori A. Clow
(74) *Attorney, Agent, or Firm* — Bond, Schoeneck & King, PLLC

(57) ABSTRACT

The present application mainly relates to specific methods for inferring activity of one or more cellular signaling pathway(s) in tissue of a medical subject based at least on the expression level(s) of one or more target gene(s) of the cellular signaling pathway(s) measured in an extracted sample of the tissue of the medical subject, an apparatus comprising a digital compressor configured to perform such methods and a non-transitory storage medium storing instructions that are executable by a digital processing device to perform such methods.

7 Claims, 48 Drawing Sheets

Specification includes a Sequence Listing.

(56) References Cited

OTHER PUBLICATIONS

Niida, Atsushi et al "Integrative Bioinformatics Analysis of Transcriptional Regulatory Programs in Breast Cancer Cells", BMC Bioinformatics, 2008, pp. 1-14.
Vaske, Charles J. et al "Inference of Patient-Specific Pathway Activities from Multi-Dimensional Cancer Genomics Data using Paradigm", Bioinformatics, vol. 26, 2010, pp. i237-i245.
Lim, Wei Keat et al "Master Regulators used as Breast Cancer Metastasis Classifier", Pacific Symposium on Biocomputing, vol. 14, 2009, pp. 504-515.
Auliac, Cedric et al "Evolutionary approches for the Reverse-Engineering of Gene Regulatory Networks: A Study on a biologically Realistic Dataset", BMC Bioinformatics, 2008, pp. 2-15.
Krishnam, Sasirekha et al "The Role of Signaling Pathways in the Expansion of Corneal Epithelial Cells in Serum-Free B27 Supplemented Medium", Molecular Vision, vol. 16, 2010, pp. 1169-1177.
Rogers, Simon et al "Bayesian Model-based Inference of Transcription Factor Activity", BMC Bioinformatics vol. 8, Suppl.2, pp. 1-11, May 2007.
Su, Junjie et al "Accurate and Reliable Cancer Classification Based on Probabilistic Inference of Pathway Activity", PLOS ONE, vol. 4, No. 12, Dec. 2009, e8161; pp. 1-10.
Kestler, Hans A. etal "From Individual Wnt Pathways towards a Wnt Signalling Network", Philosophical Transactions of the Royal Society. vol. 363, No. 1495, Apr. 2008, pp. 1333-1347.
Adams, L. Garry et al "Multi-Comparative Systems Biology Analysis Reveals Time-Course Biosignatures of in Vivo ovine Pathway Responses to B. Melitensis, *S. enterica Typhimurium* and *M. avium Paratuberculosis*", BMC Proceedings 2011, vol. 5 (Suppl.4), pp. 1-18.
Barker, Nick et al "Mining the Wnt Pathway for Cancer Therapeutics", Nature Reviews, vol. 5, No. 12, Dec. 2006, pp. 997-1014.
Ochs, Michael F. et al "Detection of Treatment-Induced Changes in Signaling Pathways in Gastrointestinal Stromal Tumors using Transcriptomic Data", Cancer Research, vol. 69, No. 23, pp. 9125-9132, 2009.
Kestler, Hans A. et al "Network Modeling of Signal Transduction: Establishing the Global View", Review Articles, Bioessays, vol. 30, 2008, pp. 1110-1125.
Elster, Eric A. et al "Probabilistic (Bayesian) Modeling of Gene Expression in Transplant Glomerulopathy", Journal of Molecular Diagnostics, vol. 12, No. 5, Sep. 2010, pp. 553-563.
Sachs, Karen et al Bayesian Network Approach to Cell Signaling Pathway Modeling, Science's STKE, 2002, pp. 1-5.
Drake, "Systems Biology Solution for Drug Discovery and Personalized Medicine", SERALOGIX, 2012, pp. 1-4.
Soderberg, Ola et al "Direct Observation of Individual Engogenous Protein Complexes in situ by Proximity Ligation" Nature Methods, vol. 3, 2006, Abstract.
Van de Wetering, Marc et al "The beta-catenin/TCF-4 Complex Imposes a Crypt Progenitor Phenotype on Colorectal Cancer Cells", Cell, vol. 111, Oct. 2002, pp. 241-250.
Hatzis, Pantelis et al "Genome-Wide Pattern of TCF7L2/TCF4 Chromatin Occupancy in Colorectal Cancer Cells", Molecular and Cellular Biology, vol. 28, No. 8, Apr. 2008, pp. 2732-2744.
De Sousa, et al "Methylation of Cancer-Stem-Cell-Associated Wnt Target Genes Predicts Poor Prognosis in Colorectal Cancer Patients", Cell Stem Cell, vol. 9, No. 5, Nov. 2011—Abstract.
Valkenburg, Kenneth C. et al "Wnt/beta-catenin Signaling in Normal and Cancer Stem Cells", Cancers, 2011, vol. 3, pp. 2050-2079.
Barker, Nick et al "Mining the Wnt Pathway for Cancer Therapeutics", Nature Reviews, Drug Discovery, vol. 5, Dec. 2006, pp. 997-1014.
Wang, Zhong et al "RNA-Seq: A Revolutionary Tool for Transcriptomics" Nature Reviews, vol. 10, Jan. 2009, pp. 57-63.
Romanuik, Tammy L. et al "Identification of Novel Androgen-Responsive Genes by Sequencing of LongSAGE Libraries", BMC Genomics, Oct. 2009, vol. 10:476: 19 pages.
Tozlu, S. et al, "Identification of Novel Genes that Co-cluster with Estrogen Receptor Alpha in Breast Tumor Biopsy Specimens, using a Large-Scale Real-Time Reverse Transcription-PCR Approach", Endocrine-Related Cancer, vol. 13, 2006, pp. 1109-1120.
Russell, Mathew C. et al "The Hedgehog Signaling Pathway in the Mouse Ovary", Biology of Reproduction, vol. 77, 2007, pp. 226-236.
Verhaegh, Wim et al "Selection of Personalized Patient Therapy through the Use of Knowledge-Based Computational Models that Identify Tumor-Driving Signal Transduction Pathways", Cancer Research, Integrated Systems and Technologies: Mathematical Oncology, Apr. 2, 2014, vol. 74(11):2936-2945.
"Measuring Functional Activity of Signal Transduction Pathways from Target Gene mRNA Levels", Education Workshop, Philips Molecular Pathway Dx, Oct. 22, 2020, 20 pages.
Verhaegh, Wim et al Knowedge-based Computational models, Oncotarget, vol. 5, No. 14, 2014, pp. 5196-5197.
Van De Stolpe, Anja et al "RNA based Approaches to Profile Oncogenic Pathways from Low Quantity Samples to Drive Precision Oncology Strategies", Frontiers in Genetics, vol. 11, Article 5998118, Feb. 2021, pp. 1-16.
Bourdeau, Veronique et al "Mechanisms of Primary and Secondary Estrogen Target Gene Regulation in Breast Cancer Cells", Nucleic Acids Research, vol. 36, No. 1, 2008, pp. 76-93.

\* cited by examiner

Evidence curated list

Broad literature list

Evidence curated list

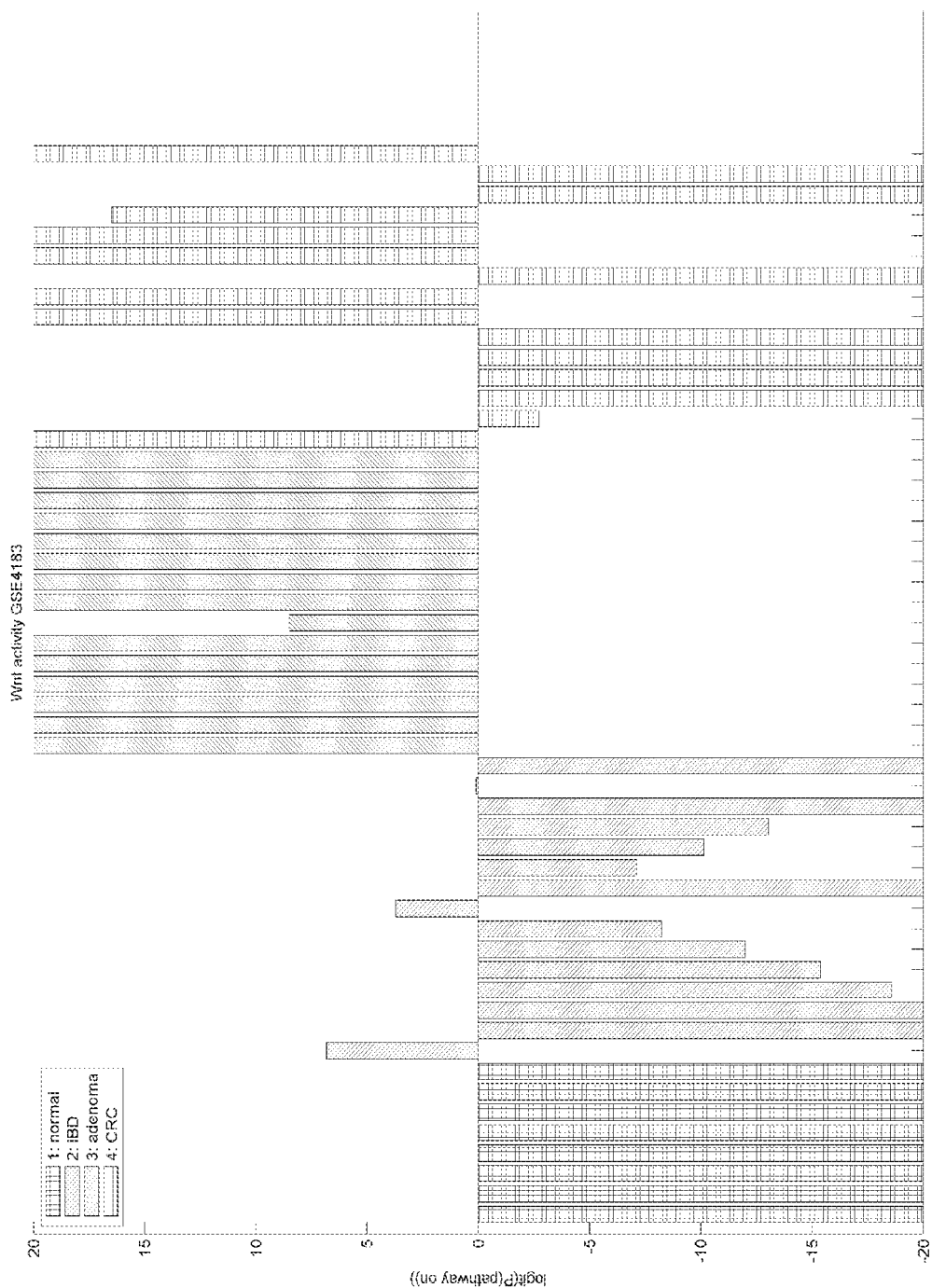
FIG. 15 (continued) Broad literature list

Evidence curated list

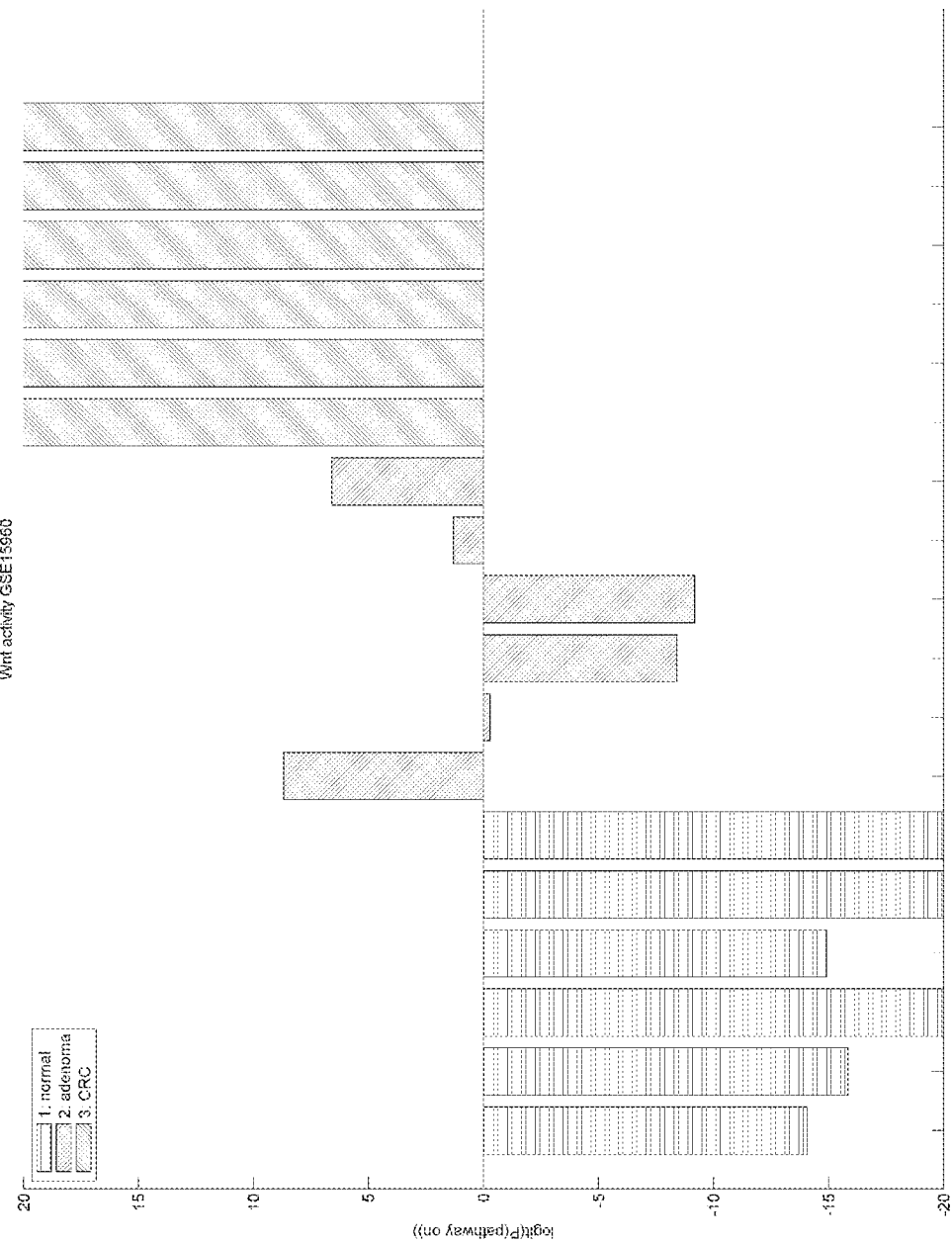

Evidence curated list

Broad literature list (continued)

Evidence curated list

Broad literature list

Evidence curated list

Broad literature list

ASSESSMENT OF CELLULAR SIGNALING PATHWAY ACTIVITY USING PROBABILISTIC MODELING OF TARGET GENE EXPRESSION

CROSS-REFERENCE TO PRIOR APPLICATIONS

This application is the U.S. National Phase application under 35 U.S.C. § 371 of International Application No. PCT/IB2012/053686, filed on Jul. 19, 2012, which claims the benefit of U.S. Provisional Application Ser. No. 61/509,137, filed Jul. 19, 2011 and European Application No. 11178148.0, filed Aug. 19, 2011. These applications are hereby incorporated by reference herein.

The subject matter described herein mainly relates to bioinformatics, genomic processing arts, proteomic processing arts, and related arts.

Genomic and proteomic analyses have substantial promise, both realized and potential, for clinical application in medical fields such as oncology, where various cancers are known to be associated with specific combinations of genomic mutations/variations and/or high or low expression levels for specific genes, which play a role in growth and evolution of cancer, e.g. cell proliferation and metastasis. For example, the Wnt signaling pathway affects regulation of cell proliferation, and is highly regulated. High Wnt pathway activity due to loss of regulation has been correlated to cancer, including malignant colon tumors. While not being limited to any particular theory of operation, it is believed that deregulation of the Wnt pathway in malignant colon cells leads to high Wnt pathway activity that in turn causes cell proliferation of the malignant colon cells, i.e. spread of colon cancer. On the other hand, abnormally low pathway activity might also be of interest, for example in the case of osteoporosis.

Technologies for acquiring genomic and proteomic data have become readily available in clinical settings. For example, measurements by microarrays are routinely employed to assess gene expression levels, protein levels, methylation, and so forth. Automated gene sequencing enables cost-effective identification of genetic variations in DNA and mRNA. Quantitative assessment of mRNA levels during gene sequencing holds promise as yet another clinical tool for assessing gene expression levels.

In spite of (or, perhaps, because of) these advances, clinical application of genomic and proteomic analyses faces a substantial hurdle—data overload. For example, the number of identifiable mutations in a single clinical sample can number in the hundreds of thousands or more. Most of these mutations are so called bystander mutations without specific contribution to cancer growth, and only a few do contribute to cancer growth and functional evolution, and these present the targets for effective treatment. Processing these large quantities of data to identify clinically useful information, like for example in the application of choosing the right therapy, is difficult.

One approach is to limit the analysis to a few canonical or standardized tests, such as tests approved by the U.S. Food and Drug Administration (FDA). In such an approach, a specific indicator or combination of indicators (e.g., mutations and/or specified high or low gene expression levels) is detected in order to test "positive" for the indicated disease condition (e.g., a particular type of cancer). The canonical test is supported by clinical studies that have shown strong correlation with the disease condition or with treatment efficacy. This approach is useful only for those clinical conditions for which a canonical test has been developed, e.g. specific diagnosis of a disease, or predicting response to a drug in a specific cancer type at a specific stage, and is also rigid as it is only applicable for the canonical conditions.

Another approach is based on identification of functionally related groups of genomic or proteomic indicators. For example, the Wnt pathway comprises a cascade of proteomic reactions. Major components of this chain include (but are not limited to) binding of the Wnt signaling protein to a frizzled surface receptor of the cell which causes activation of proteins of the disheveled family of proteins which in turn impact the level of transcription agents such as $\beta$-catenin/TCF4 based protein complexes in the cell nucleus. These transcription agents, in turn, control transcription of target mRNA molecules that in turn are translated into target proteins of the Wnt pathway. Clinical studies have shown some correlations between regulatory proteins of the Wnt pathway and the activity of the Wnt pathway.

However, applying such clinical study results to the diagnosis and clinical evaluation of a specific patient is difficult due to the complexity of signaling pathways, e.g. the Wnt pathway. As a simple example, measurement of the expression level of a protein that is "upstream" in the Wnt pathway may fail to detect abnormal behavior of a protein that is "downstream" in the Wnt pathway. It is believed that the Wnt pathway includes numerous feedback mechanisms and the simplified concept of "upstream" and "downstream" may be inapplicable for a substantial portion of the Wnt pathway; more generally, abnormal behavior in one portion of the protein cascade comprising the Wnt pathway may have more or less effect on other portions of the protein cascade, and on the activity of the Wnt pathway as a whole. Still further, in some clinical studies protein expression levels for regulatory proteins of the signaling cascade are assessed by measuring mRNA expression levels of the genes that encode for the regulatory proteins. This is an indirect measurement that may not accurately assess the regulatory protein expression level, and hardly ever reflects the amount of active proteins (after a specific post-translational modification like phosphorylation).

The main problem underlying the present invention was thus to provide suitable methods and means for performing genomic and, respectively, proteomic analyses. Specific aspects of the underlying problem as well as further objections in connection with the present invention become apparent when studying the description, the examples provided herein and, in particular, when studying the attached claims.

The present invention provides new and improved methods and apparatuses as disclosed herein.

In accordance with a main aspect of the present invention, the above problem is solved by a specific method for assessing cellular signaling pathway activity using probabilistic modeling of target gene expression, namely a method comprising: inferring activity of one or more cellular signaling pathway(s) in tissue of a medical subject based at least on the expression level(s) (in particular on mRNA and/or protein level) of one or more target gene(s) of the cellular signaling pathway(s) measured in an extracted sample of the tissue of the medical subject, wherein the inferring comprises: inferring activity of the cellular signaling pathway(s) in the tissue of the medical subject by evaluating at least a portion of a probabilistic model, preferably a Bayesian network, representing the cellular signaling pathway(s) for a set of inputs including at least the expression level(s) of the one or more target genes of the cellular signaling pathway(s) measured in the extracted sample of the tissue of the medical subject; estimating a level in the tissue of the medical subject of at least one transcription factor (TF) element, the at least one TF element controlling transcription of the one or more target gene(s) of the cellular signaling pathway(s), the estimating being based at least in part on conditional probabilities relating the at least one TF element and the expression level(s) of the one or more target gene(s) of the cellular signaling pathway(s) measured in the extracted sample of the tissue of the medical subject; and inferring activity of the cellular signaling pathway(s) based on the estimated level in the tissue sample of the transcription factor; and determining whether the cellular signaling pathway(s) is/are operating abnormally in the tissue of the medical subject based on the inferred activity of the cellular signaling pathway(s) in the tissue of the medical subject; wherein the inferring is performed by a digital processing device using the probabilistic model of the cellular signaling pathway(s).

The "target gene(s)" may be "direct target genes" and/or "indirect target genes" (as described herein).

Preferably the inferring comprises estimating a level in the tissue of the medical subject of at least one transcription factor (TF) element represented by a TF node of the probabilistic model, the TF element controlling transcription of the one or more target gene(s) of the cellular signaling pathway(s), the estimating being based at least in part on conditional probabilities of the probabilistic model relating the TF node and nodes in the probabilistic model representing the one or more target gene(s) of the cellular signaling pathway(s) measured in the extracted sample of the tissue of the medical subject.

The probabilistic model may be a Bayesian network model. Thus, according to a preferred embodiment the inferring is performed by using a Bayesian network comprising nodes representing information about the signaling pathway(s) and conditional probability relationships between connected nodes of the Bayesian network.

The cellular signaling pathway(s) may be a Wnt pathway, an ER (Estrogen Receptor) pathway, an AR (Androgen Receptor) pathway and/or a Hedgehog pathway. Thus, according to a preferred embodiment the cellular signaling pathway(s) comprise(s) a Wnt pathway, an ER pathway, an AR pathway and/or a Hedgehog pathway.

Particularly suitable target genes are described in the following text passages as well as the examples below (see e.g. Tables 1-9).

Thus, according to a preferred embodiment the target gene(s) is/are selected from the group comprising or consisting of target genes listed in Table 1 or Table 6 (for Wnt pathway), target genes listed in Table 2, Table 5 or Table 7 (for ER pathway), target genes listed in Table 3 or Table 8 (for Hedgehog pathway) and target genes listed in Table 4 or Table 9 (for AR pathway).

Particularly preferred is a method wherein the inferring comprises: inferring activity of a Wnt pathway in the tissue of the medical subject based at least on expression levels of one or more, preferably at least three, target gene(s) of the Wnt pathway measured in the extracted sample of the tissue of the medical subject selected from the group comprising or consisting of: KIAA1199, AXIN2, RNF43, TBX3, TDGF1, SOX9, ASCL2, IL8, SP5, ZNRF3, KLF6, CCND1, DEFA6 and FZD7.

Further preferred is a method, wherein the inferring is further based on expression levels of at least one target gene of the Wnt pathway measured in the extracted sample of the tissue of the medical subject selected from the group comprising or consisting of: NKD1, OAT, FAT1, LEF1, GLUL, REG1B, TCF7L2, COL18A1, BMP7, SLC1A2, ADRA2C, PPARG, DKK1, HNF1A and LECT2.

Particularly preferred is a method wherein the inferring (also) comprises: inferring activity of an ER pathway in the tissue of the medical subject based at least on expression levels of one or more, preferably at least three, target gene(s) of the ER pathway measured in the extracted sample of the tissue of the medical subject selected from the group comprising or consisting of: CDH26, SGK3, PGR, GREB1, CA12, XBP1, CELSR2, WISP2, DSCAM, ERBB2, CTSD, TFF1 and NRIP1.

Further preferred is a method, wherein the inferring is further based on expression levels of at least one target gene of the ER pathway measured in the extracted sample of the tissue of the medical subject selected from the group comprising or consisting of: AP1B1, ATPSJ, COL18A1, COX7A2L, EBAG9, ESR1, HSPB1, IGFBP4, KRT19, MYC, NDUFV3, PISD, PREDM15, PTMA, RARA, SOD1 and TRIM25.

A method wherein the inferring (also) comprises inferring activity of a Hedgehog pathway in the tissue of the medical subject based at least on expression levels of one or more, preferably at least three, target gene(s) of the Hedgehog pathway measured in the extracted sample of the tissue of the medical subject selected from the group comprising or consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN and CTSL1, is also preferred.

Further preferred is a method, wherein the inferring is further based on expression levels of at least one target gene of the Hedgehog pathway measured in the extracted sample of the tissue of the medical subject selected from the group comprising or consisting of: BCL2, FOXA2, FOXF1, G19, HHIP, IL1R2, JAG2, JUP, MIF, MYLK, NKX2.2, NKX2.8, PITRM1 and TOM1.

Also preferred is a method wherein the inferring (also) comprises inferring activity of an AR pathway in the tissue of the medical subject based at least on expression levels of one or more, preferably at least three, target gene(s) of the AR pathway measured in the extracted sample of the tissue of the medical subject selected from the group comprising or consisting of: KLK2, PMEPA1, TMPRSS2, NKX3_1, ABCC4, KLK3, FKBP5, ELL2, UGT2B15, DHCR24, PPAP2A, NDRG1, LRIG1, CREB3L4, LCP1, GUCY1A3, AR and EAF2, is also preferred.

Further preferred is a method, wherein the inferring is further based on expression levels of at least one target gene of the AR pathway measured in the extracted sample of the tissue of the medical subject selected from the group comprising or consisting of: APP, NTS, PLAU, CDKN1A, DRG1, FGF8, IGF1, PRKACB, PTPN1, SGK1 and TACC2.

Another aspect of the present invention relates to a method (as described herein), further comprising: recommending prescribing a drug for the medical subject that corrects for abnormal operation of the cellular signaling pathway(s); wherein the recommending is performed only if the cellular signaling pathway(s) is/are determined to be operating abnormally in the tissue of the medical subject based on the inferred activity of the cellular signaling pathway(s).

The present invention also relates to a method (as described herein) comprising: inferring activity of a Wnt pathway in tissue of a medical subject based at least on expression levels of two, three or more target genes of a set of target genes of the Wnt pathway measured in an extracted sample of the tissue of the medical subject and/or inferring activity of an ER pathway in tissue of a medical subject based at least on expression levels of two, three or more target genes of a set of target genes of the ER pathway measured in an extracted sample of the tissue of the medical subject and/or inferring activity of a Hedgehog pathway in tissue of a medical subject based at least on expression levels of two, three or more target genes of a set of target genes of the Hedgehog pathway measured in an extracted sample of the tissue of the medical subject, and/or inferring activity of an AR pathway in tissue of a medical subject based at least on expression levels of two, three or more target genes of a set of target genes of the AR pathway measured in an extracted sample of the tissue of the medical subject.

Preferably, the set of target genes of the Wnt pathway includes at least nine, preferably all target genes selected from the group comprising or consisting of: KIAA1199, AXIN2, RNF43, TBX3, TDGF1, SOX9, ASCL2, IL8, SP5, ZNRF3, KLF6, CCND1, DEFA6 and FZD7, and/or the set of target genes of the ER pathway includes at least nine, preferably all target genes selected from the group comprising or consisting of: CDH26, SGK3, PGR, GREB1, CA12, XBP1, CELSR2, WISP2, DSCAM, ERBB2, CTSD, TFF1 and NRIP1, and/or the set of target genes of the Hedgehog pathway includes at least nine, preferably all target genes selected from the group comprising or consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN and CTSL1, and/or the set of target genes of the AR pathway includes at least nine, preferably all target genes selected from the group comprising or consisting of: KLK2, PMEPA1, TMPRSS2, NKX3_1, ABCC4, KLK3, FKBPS, ELL2, UGT2B15, DHCR24, PPAP2A, NDRG1, LRIG1, CREB3L4, LCP1, GUCY1A3, AR and EAF2.

Also preferred is a method, wherein the set of target genes of the Wnt pathway further includes at least one target gene selected from the group comprising or consisting of: NKD1, OAT, FAT1, LEF1, GLUL, REG1B, TCF7L2, COL18A1, BMP7, SLC1A2, ADRA2C, PPARG, DKK1, HNF1A and LECT2, and/or the set of target genes of the ER pathway further includes at least one target gene selected from the group comprising or consisting of: AP1B1, ATPSJ, COL18A1, COX7A2L, EBAG9, ESR1, HSPB1, IGFBP4, KRT19, MYC, NDUFV3, PISD, PREDM15, PTMA, RARA, SOD1 and TRIM25, and/or the set of target genes of the Hedgehog pathway further includes at least one target gene selected from the group comprising or consisting of: BCL2, FOXA2, FOXF1, G19, HHIP, IL1R2, JAG2, JUP, MIF, MYLK, NKX2.2, NKX2.8, PITRM1 and TOM1, and/or the set of target genes of the AR pathway further includes at least one target gene selected from the group comprising or consisting of: APP, NTS, PLAU, CDKN1A, DRG1, FGF8, IGF1, PRKACB, PTPN1, SGK1 and TACC2, is particularly preferred.

The sample(s) to be used in accordance with the present invention can be, e.g., a sample obtained from a breast lesion, or from a colon of a medical subject known or suspected of having colon cancer, or from a liver of a medical subject known or suspected of having liver cancer, or so forth, preferably via a biopsy procedure or other sample extraction procedure. The tissue of which a sample is extracted may also be metastatic tissue, e.g. (suspected) malignant tissue originating from the colon, breast, liver, or other organ that has spread outside of the colon, breast, liver, or other organ. In some cases, the tissue sample may be circulating tumor cells, that is, tumor cells that have entered the bloodstream and may be extracted as the extracted tissue sample using suitable isolation techniques.

Another disclosed aspect of the present invention pertain the use of a non-transitory storage medium as described herein or a computer program as described herein for specific diagnosis of a disease or predicting response to a drug in a specific cancer type at a specific stage.

In accordance with another disclosed aspect, an apparatus comprising a digital processor configured to perform a method according to the invention as described herein.

In accordance with another disclosed aspect, a non-transitory storage medium stores instructions that are executable by a digital processing device to perform a method according to the invention as described herein. The non-transitory storage medium may be a computer-readable storage medium, such as a hard drive or other magnetic storage medium, an optical disk or other optical storage medium, a random access memory (RAM), read-only memory (ROM), flash memory, or other electronic storage medium, a network server, or so forth. The digital processing device may be a handheld device (e.g., a personal data assistant or smartphone), a notebook computer, a desktop computer, a tablet computer or device, a remote network server, or so forth.

In accordance with another disclosed aspect, a computer program comprises program code means for causing a digital processing device to perform a method according to the invention as described herein. The digital processing device may be a handheld device (e.g., a personal data assistant or smartphone), a notebook computer, a desktop computer, a tablet computer or device, a remote network server, or so forth.

One advantage resides in a clinical decision support (CDS) system providing clinical recommendations based on probabilistic analysis of one or more cellular signaling pathway(s), for example using a Bayesian network model of a Wnt pathway, an ER pathway, an AR pathway and/or a Hedgehog pathway.

Another advantage resides in improved assessment of cellular signaling pathway activity that is less susceptible to error.

Another advantage resides in providing a CDS system recommending targeted treatment for loss of regulation of a cellular signaling pathway.

Another advantage resides in providing a CDS system that is designed to detect loss of regulation for a particular cellular signaling pathway, such as a Wnt pathway, an ER pathway, an AR pathway or a Hedgehog pathway, and is readily adapted to provide recommendations for different types of cancer sourced by that particular cellular signaling pathway.

The present invention as described herein can, e.g., also advantageously be used in connection with: diagnosis based on predicted (inferred) activity; prognosis based on predicted (inferred) activity; drug prescription based on predicted (inferred) activity; prediction of drug efficacy based on predicted (inferred) activity; prediction of adverse effects based on predicted (inferred) activity; monitoring of drug efficacy; drug development; assay development; pathway research; cancer staging; enrollment of subject in a clinical trial based on predicted (inferred) activity; selection of subsequent test to be performed, and/or; selection of companion diagnostics tests.

Further advantages will be apparent to those of ordinary skill in the art upon reading and understanding the attached figures, the following description and, in particular, upon reading the detailed examples provided herein below.

FIG. 1 shows a simple Bayesian network representing part of a cellular signaling pathway. The cellular signaling pathway is symbolized by a transcription factor (TF) complex and the target genes produced as a result of the transcription factor complex being present. The probabilistic relationship between the TF element and a target gene in case of binary discretization can be represented by a conditional probability table as depicted in the diagram.

FIG. 2 shows an illustrative Bayesian network describing a hypothetical cellular signaling pathway. Both the upstream proteins and downstream target mRNA nodes are depicted in the diagram. The upstream proteins serve as input in the transcription factor complex, whereas the target mRNAs are the transcription factor complex's output nodes.

Figure 20:
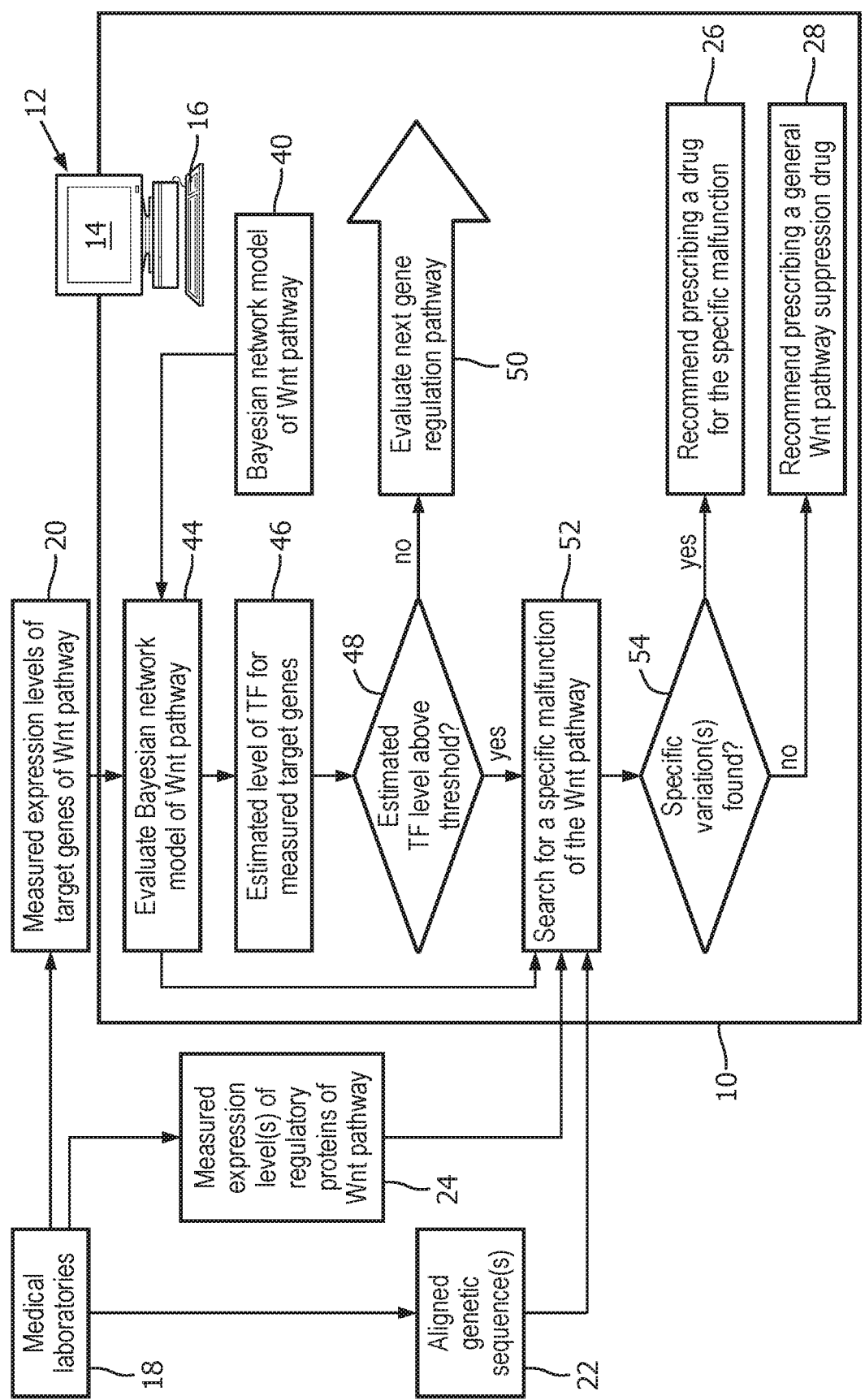

FIG. 20 diagrammatically shows a clinical decision support (CDS) system configured to assess one or more cellular signaling pathway(s) as disclosed herein (exemplary shown for Wnt pathway).

Figure 21:
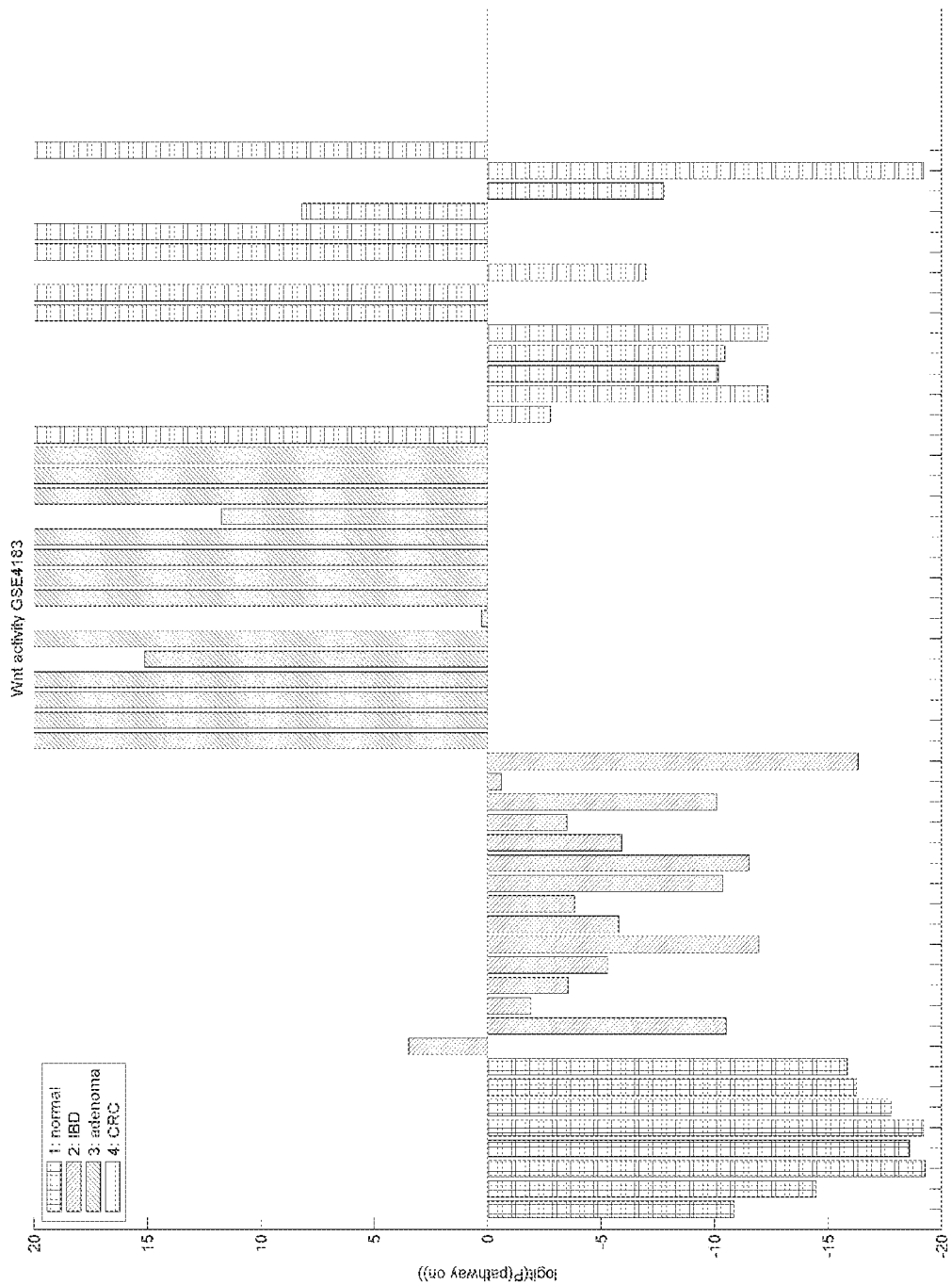

FIG. 21 shows a predicted Wnt pathway activity in colon samples from GSE4183.

Figure 22:
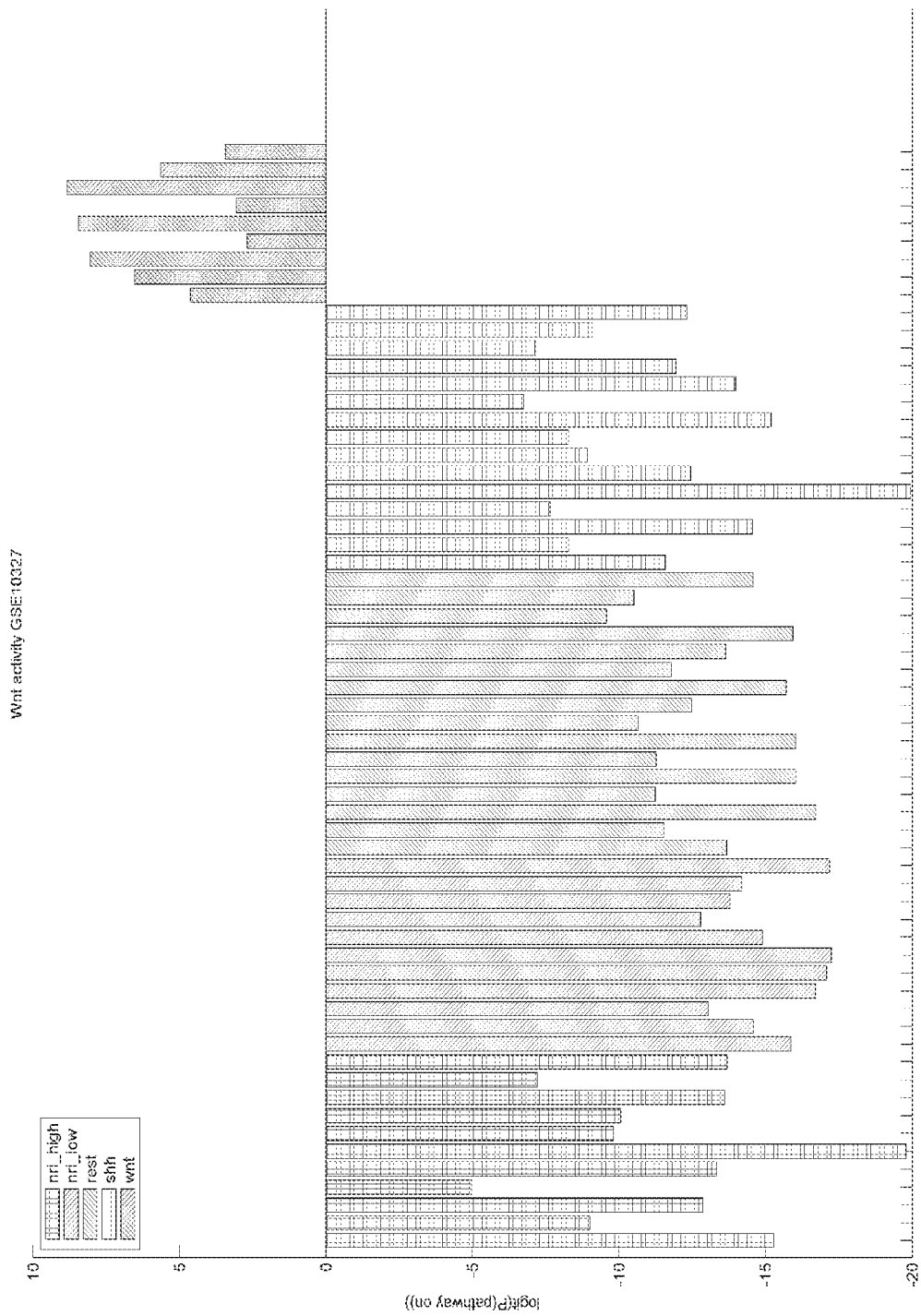

FIG. 22 shows a predicted Wnt pathway activity in medulloblastoma samples from GSE10327.

Figure 23:
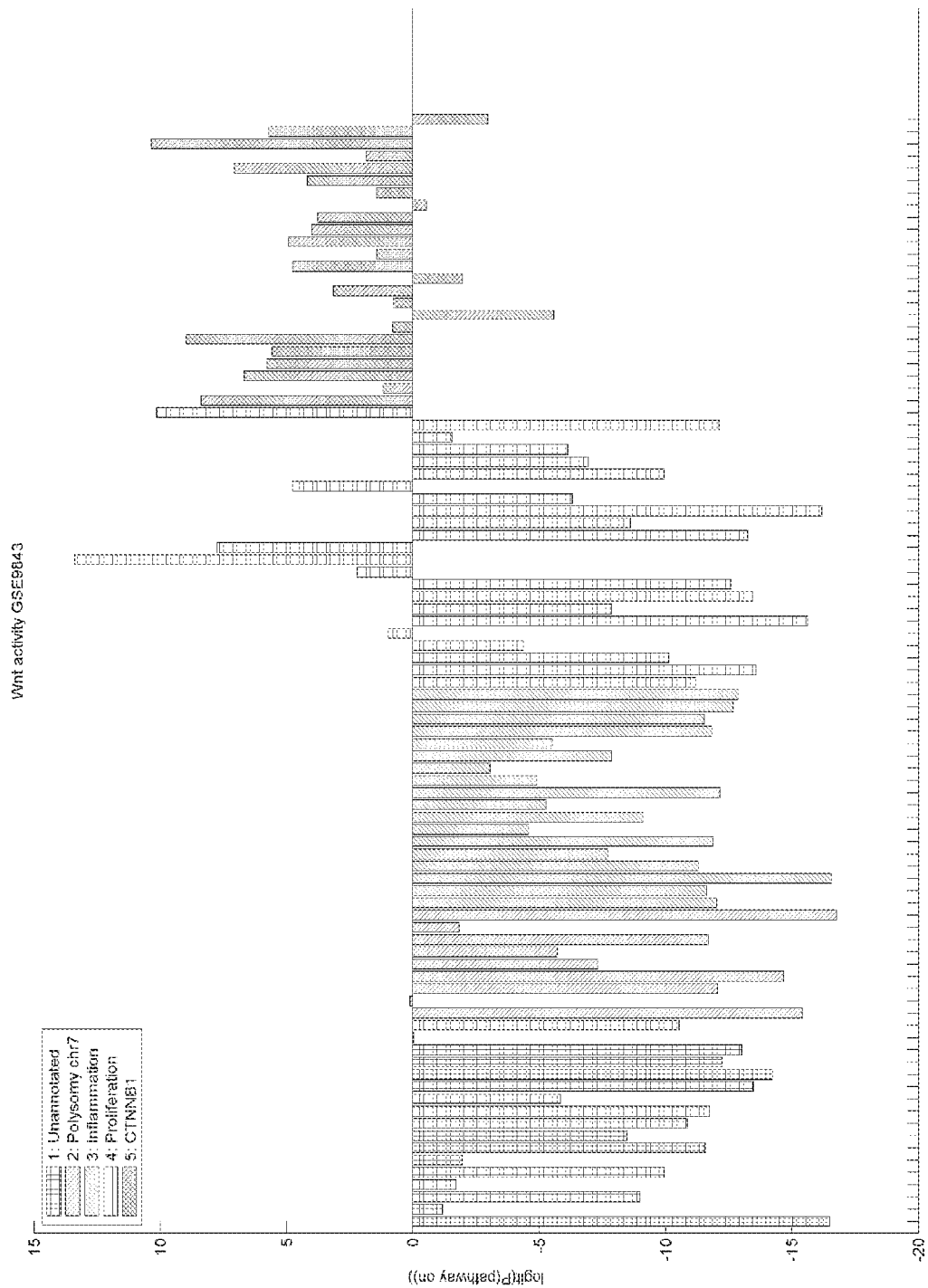

FIG. 23 shows a predicted Wnt pathway activity in liver cancer samples from GSE9843.

Figure 24:
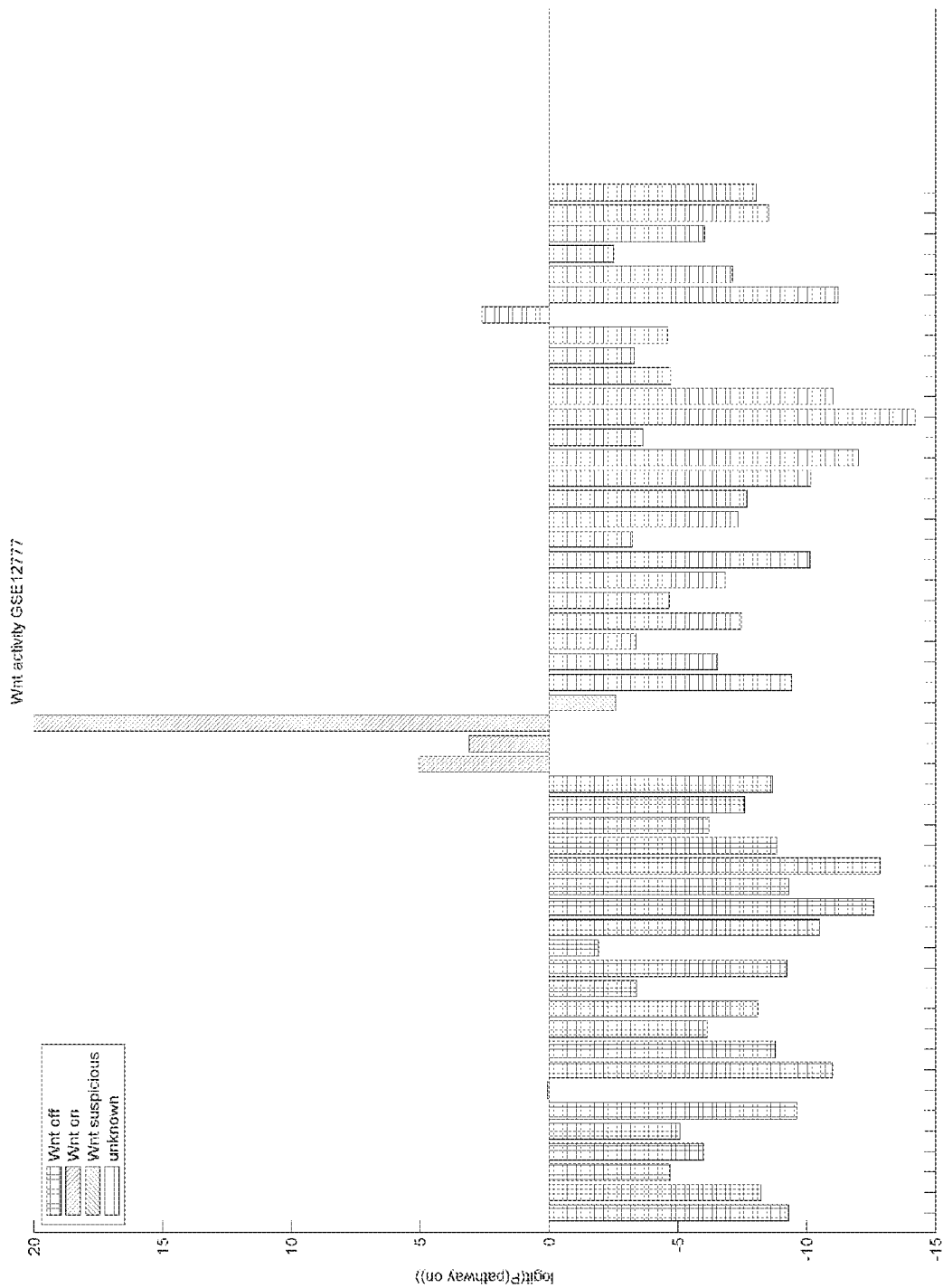

FIG. 24 shows a predicted Wnt pathway activity in breast cancer cell lines from GSE12777.

Figure 25:
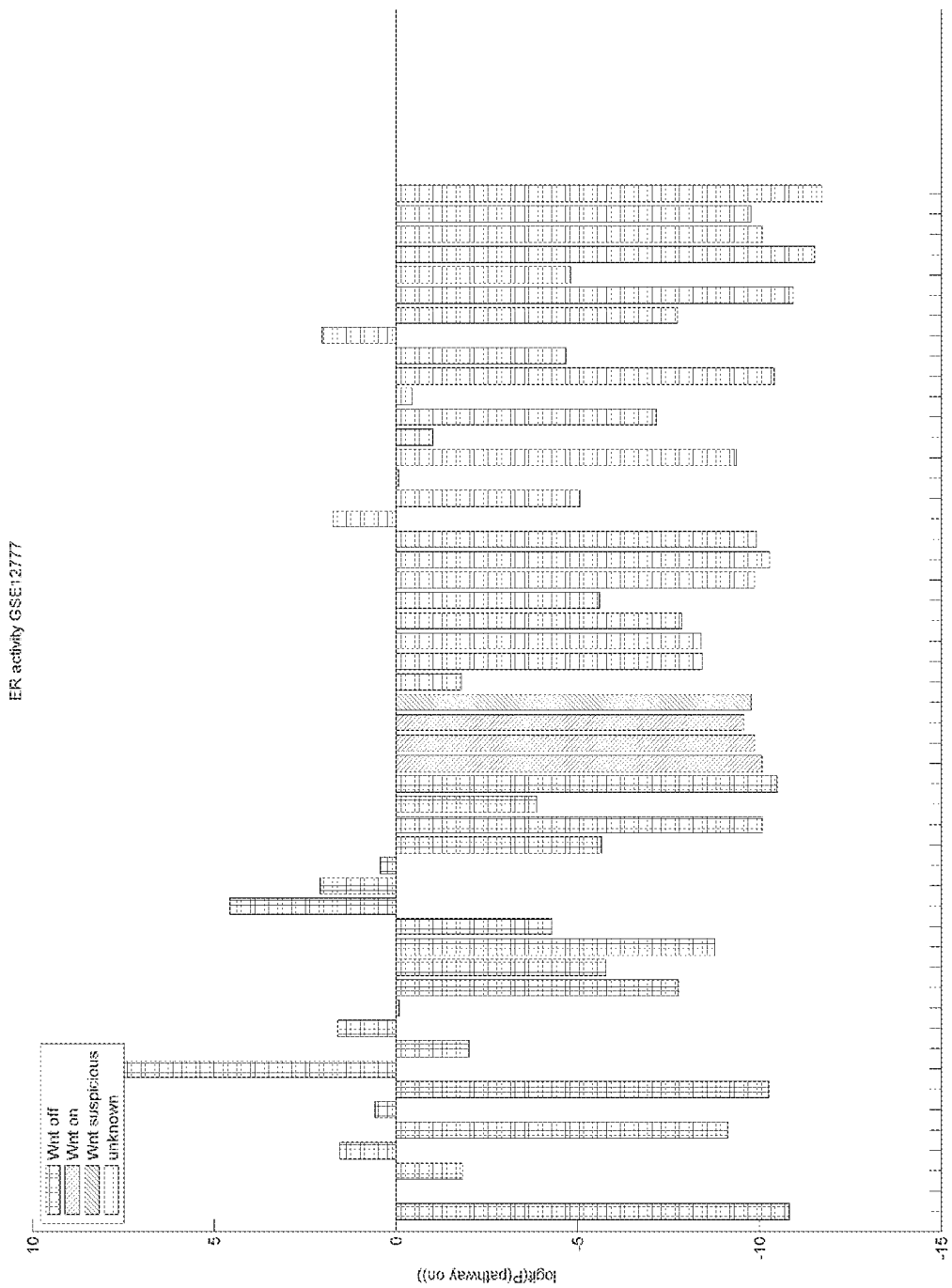

FIG. 25 shows a predicted ER pathway activity in breast cancer cell lines from GSE12777.

Figure 26:
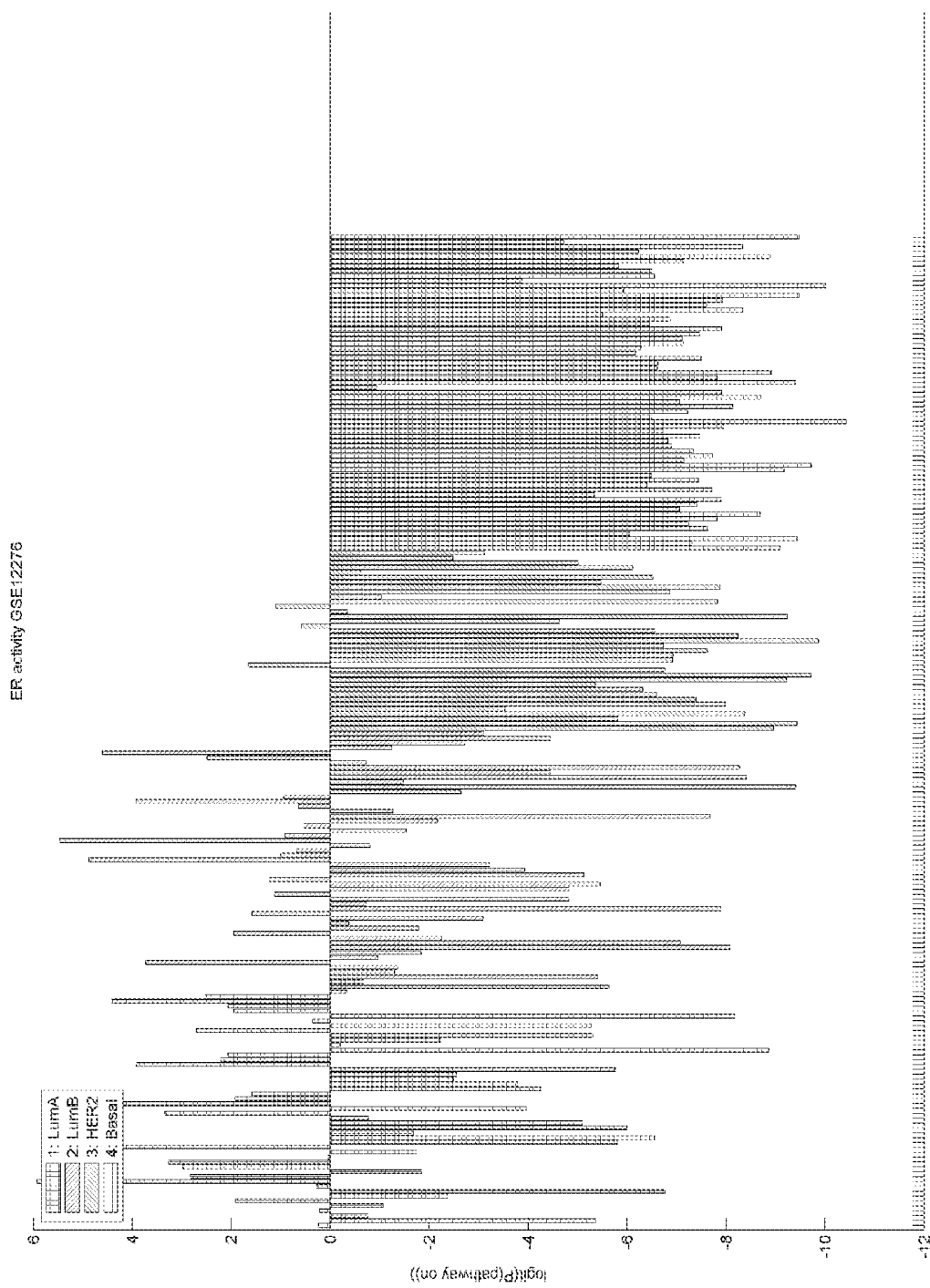

FIG. 26 shows a predicted ER pathway activity in breast cancer samples from GSE12276.

Figure 27:
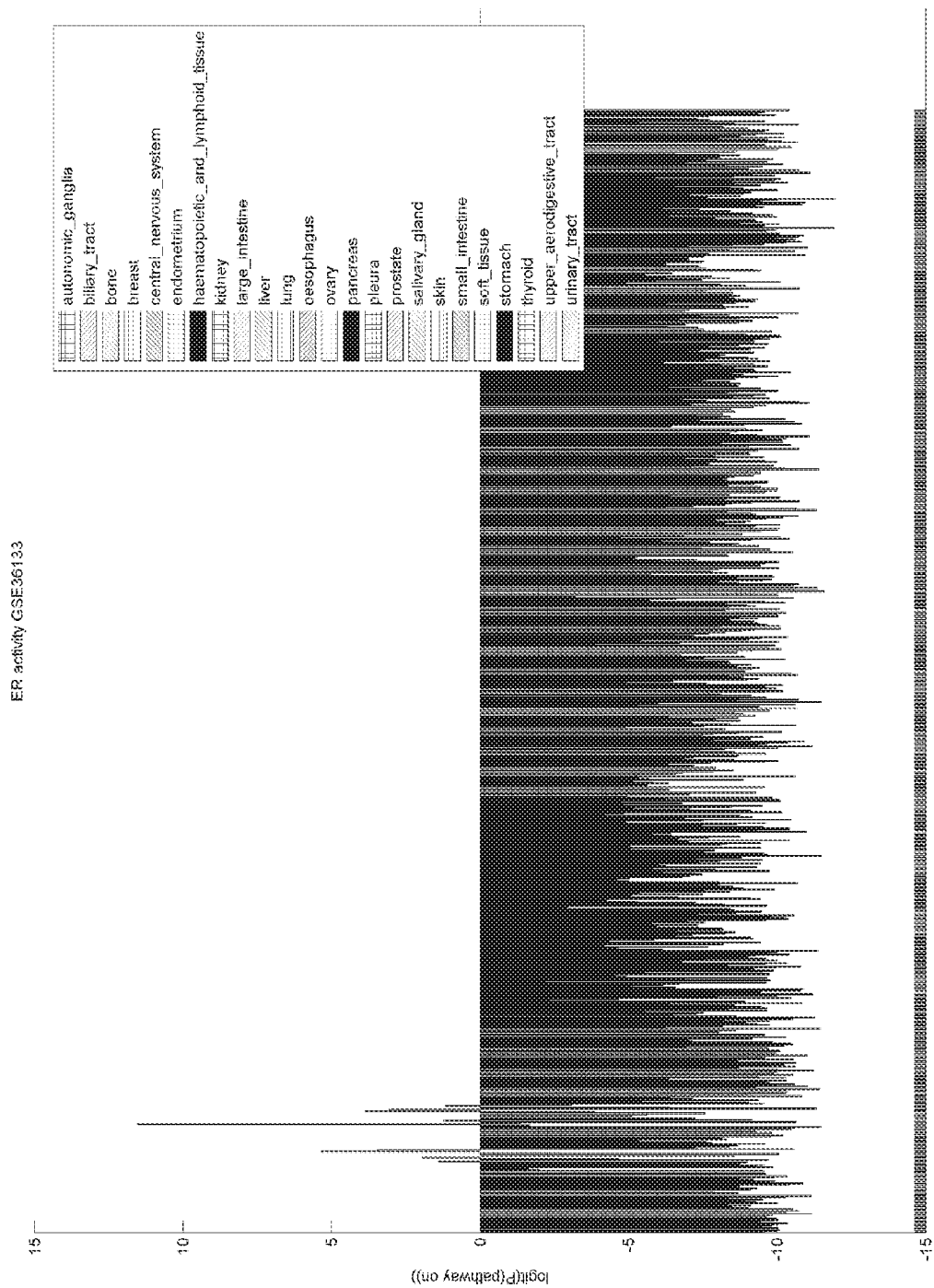

FIG. 27 shows a predicted ER pathway activity in cancer cell lines from GSE36133.

Figure 28:
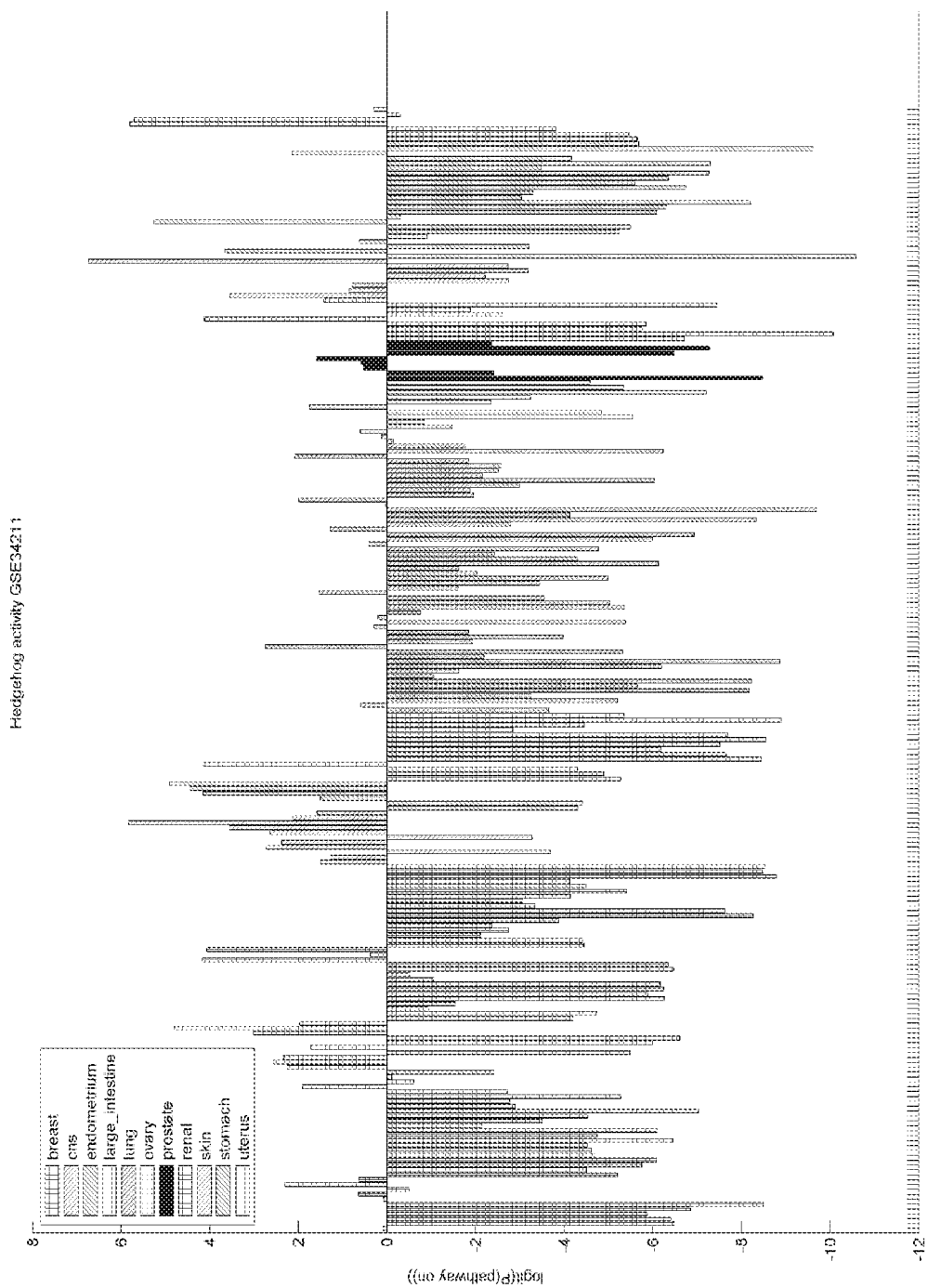

FIG. 28 shows a predicted Hedgehog pathway activity in cancer cell lines from GSE34211.

Figure 29:
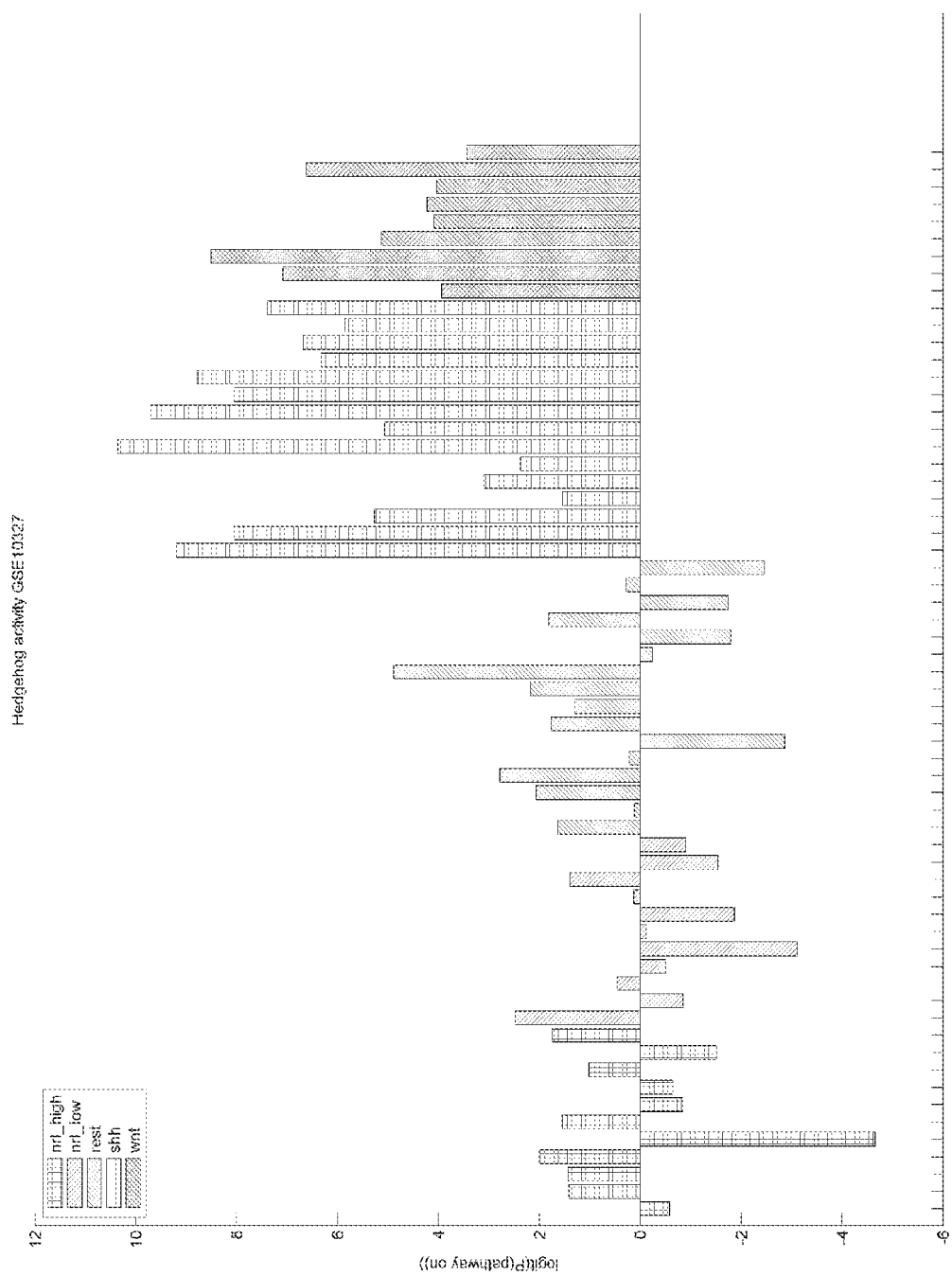

FIG. 29 shows a predicted Hedgehog pathway activity in medulloblastoma samples from GSE10327.

Figure 30:
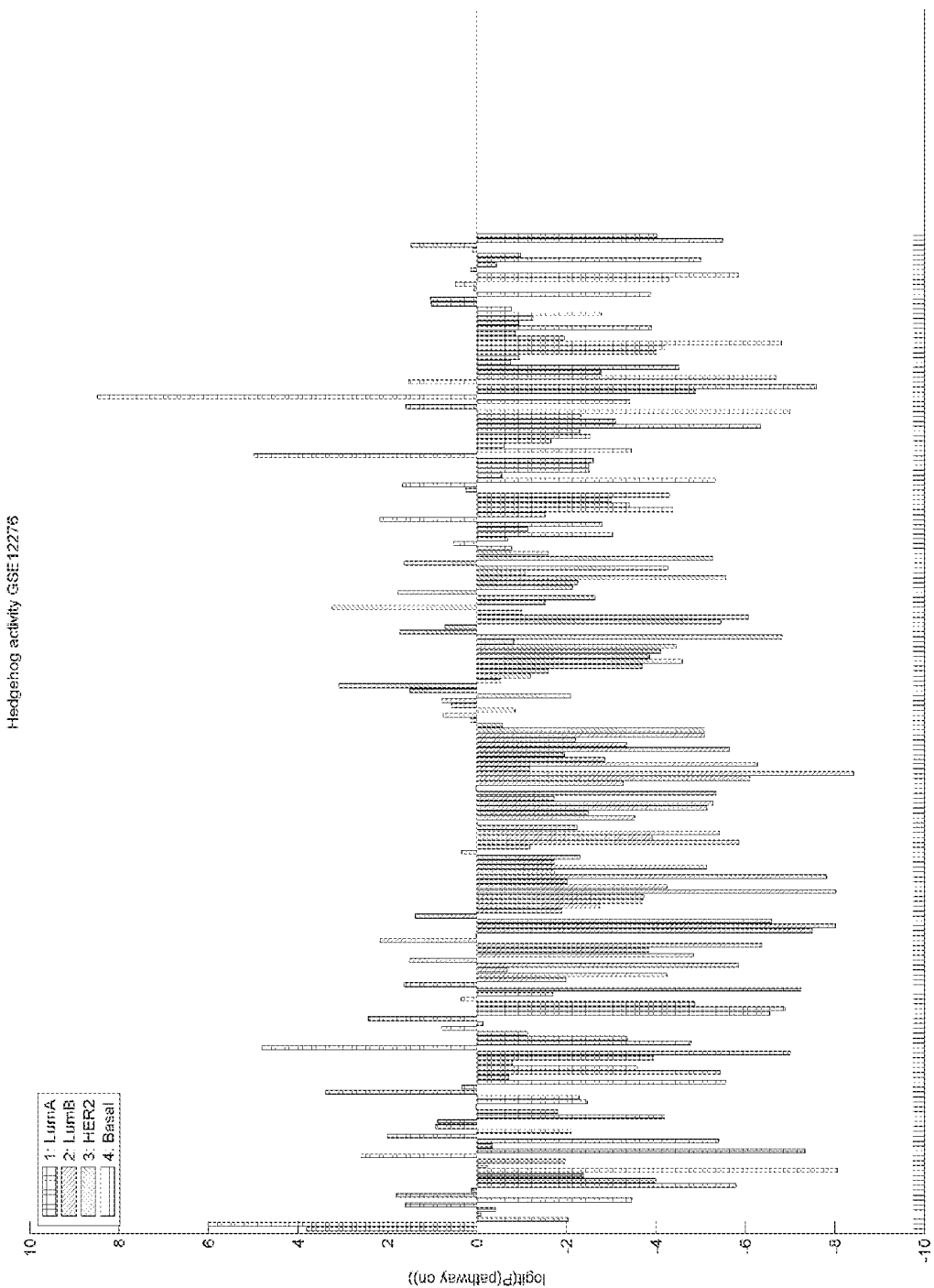

FIG. 30 shows a predicted Hedgehog pathway activity in breast cancer samples from GSE12276.

Figure 31:
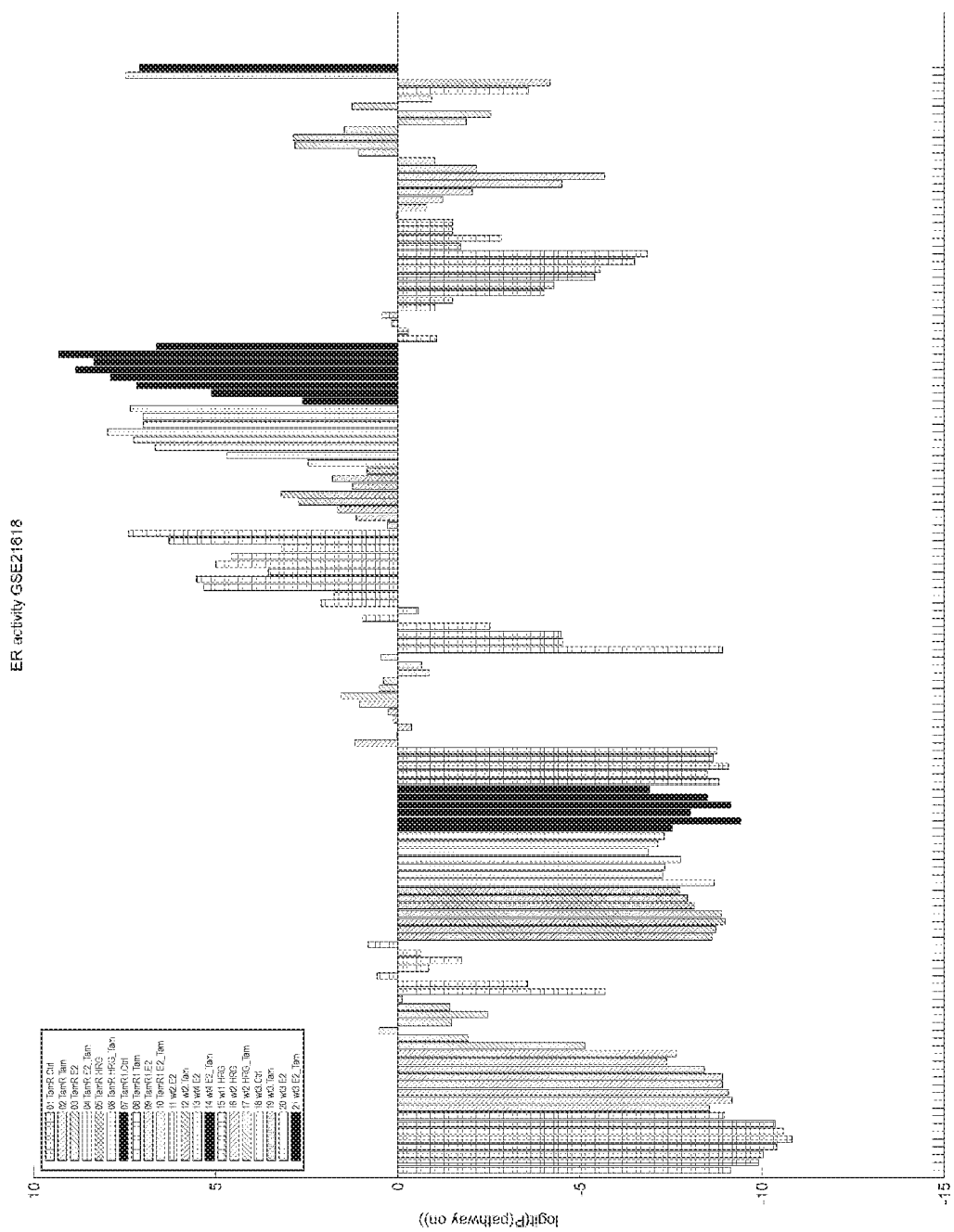

FIG. 31 shows a predicted ER pathway activity in MCF7 and Tamoxifen resistant cell lines from GSE21618.

Figure 32:
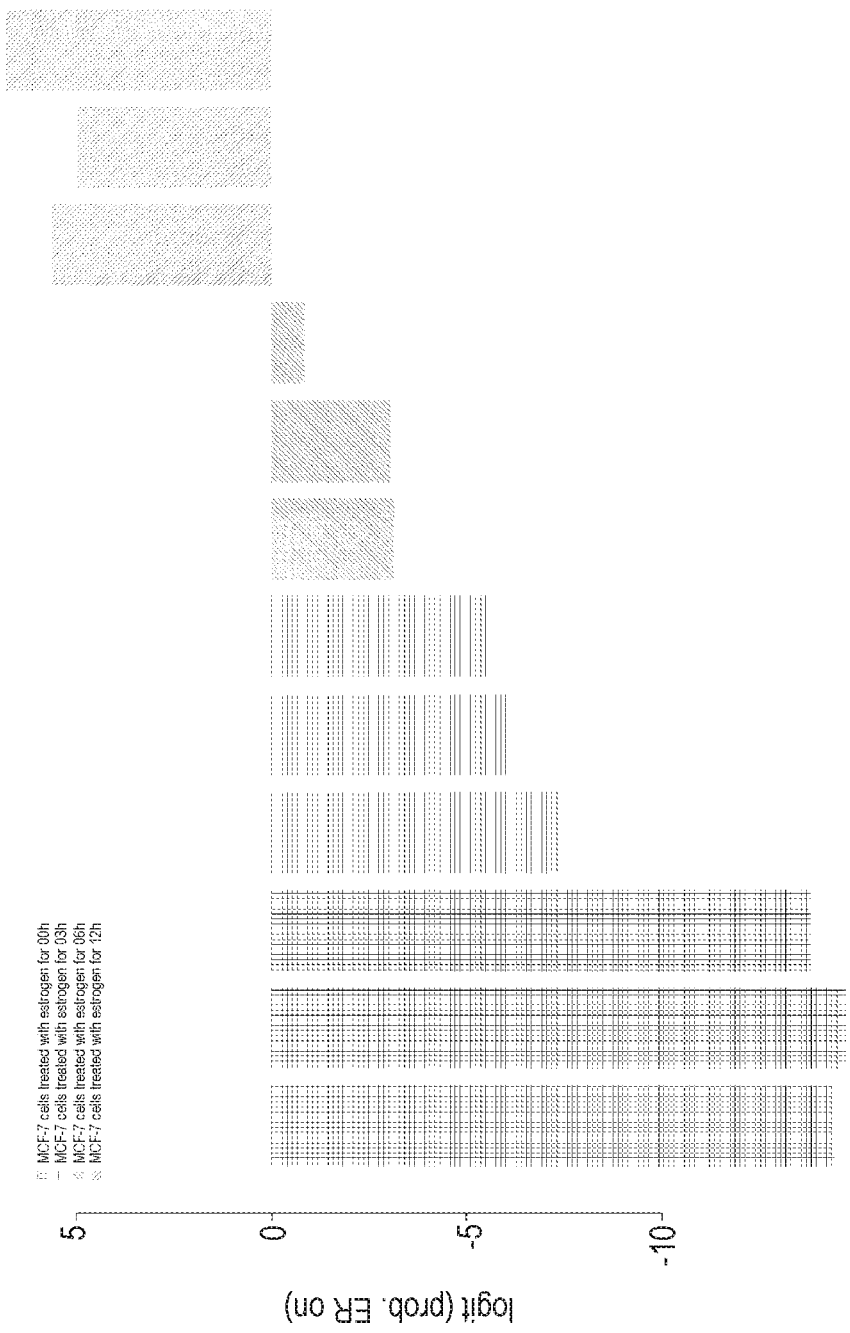

FIG. 32 shows a predicted ER pathway activity in a time series of estrogen-stimulated MCF7 cell line samples from GSE11324.

Figure 33:
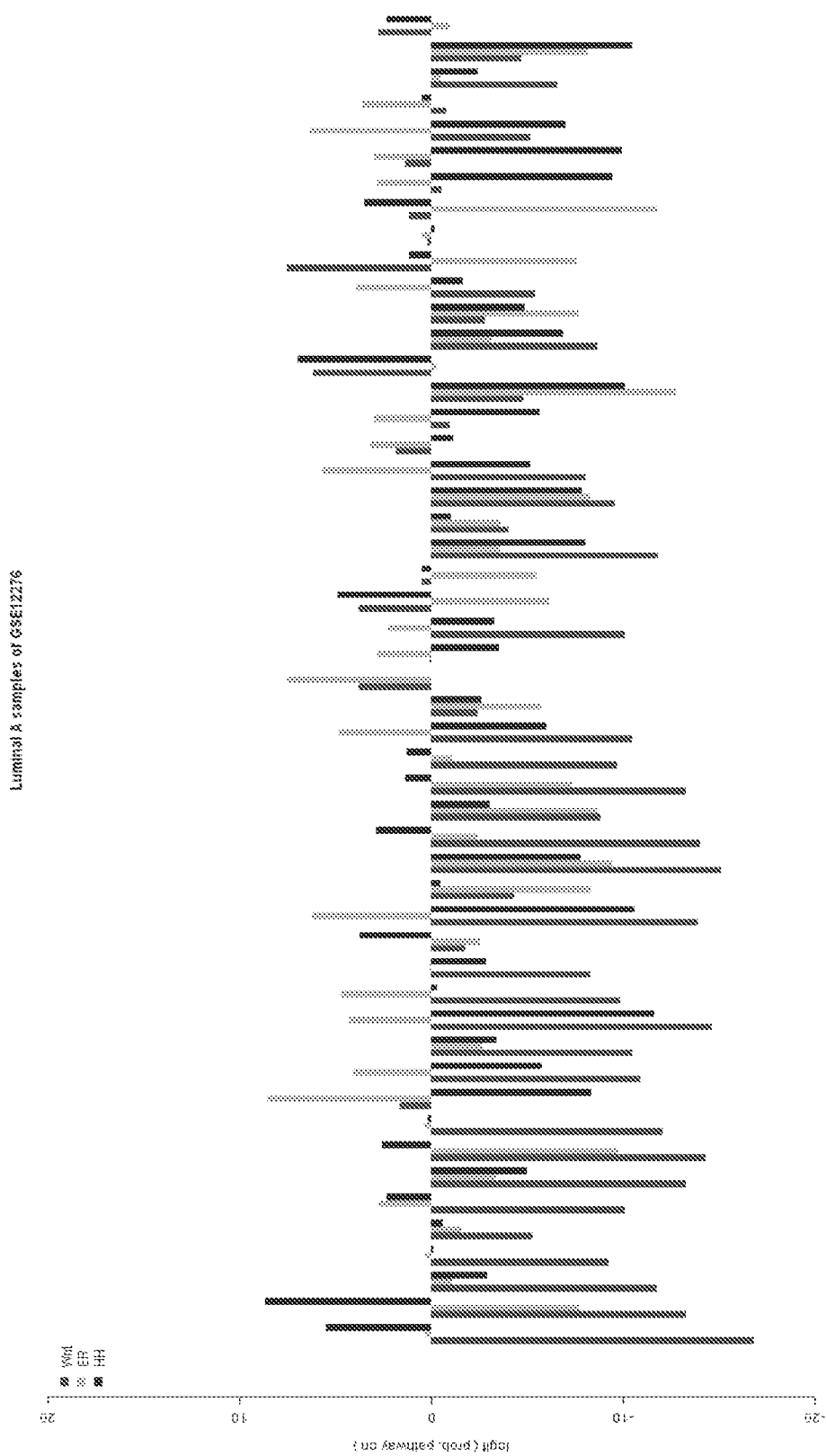

FIG. 33 shows Wnt, ER and Hedgehog pathway activity in luminal A samples of GSE12276.

Figure 34:
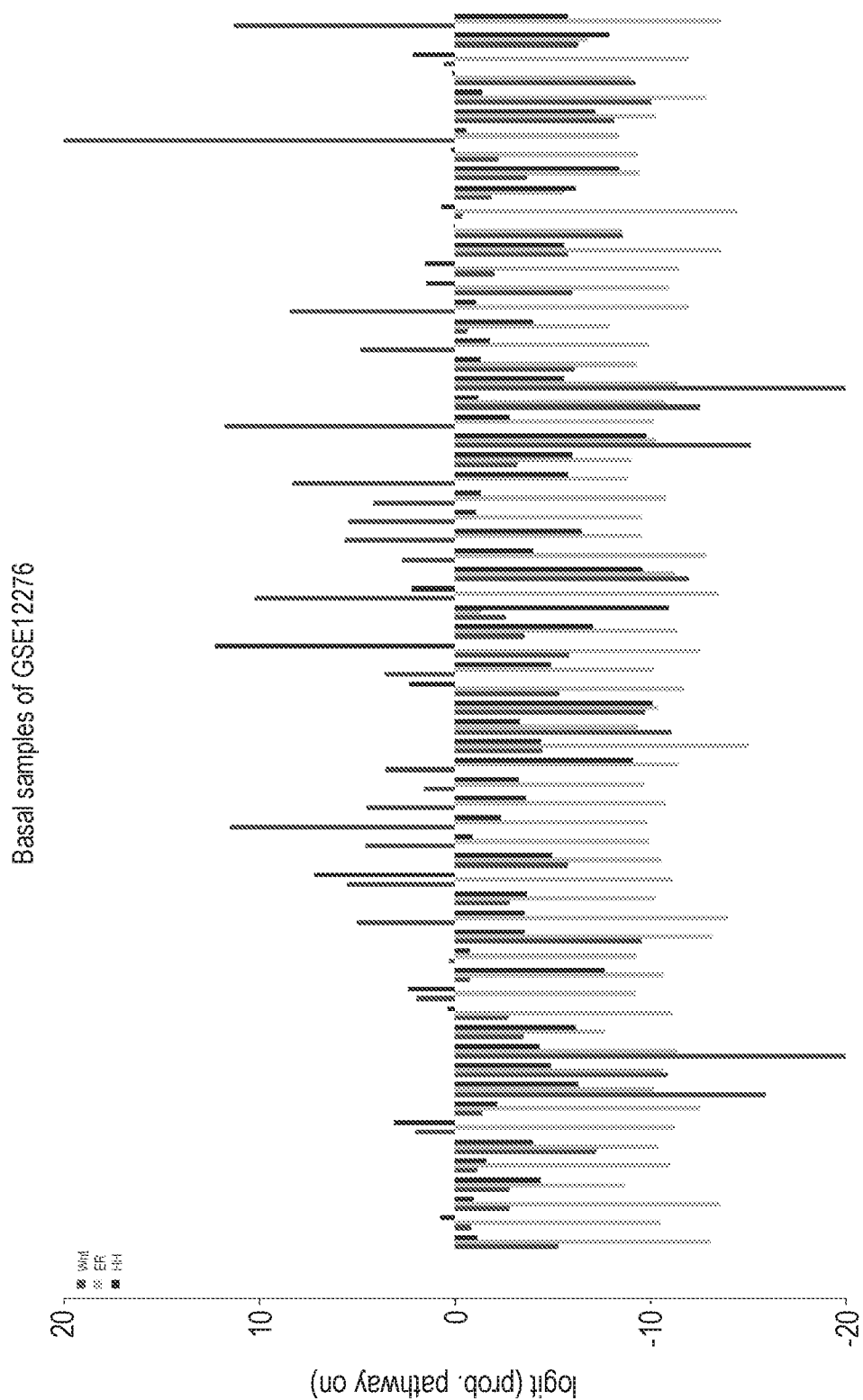

FIG. 34 shows Wnt, ER and Hedgehog pathway activity in basal samples of GSE12276.

Figure 35:

FIG. 35 shows a predicted Wnt pathway activity in colon samples from GSE20916.

Figure 36:
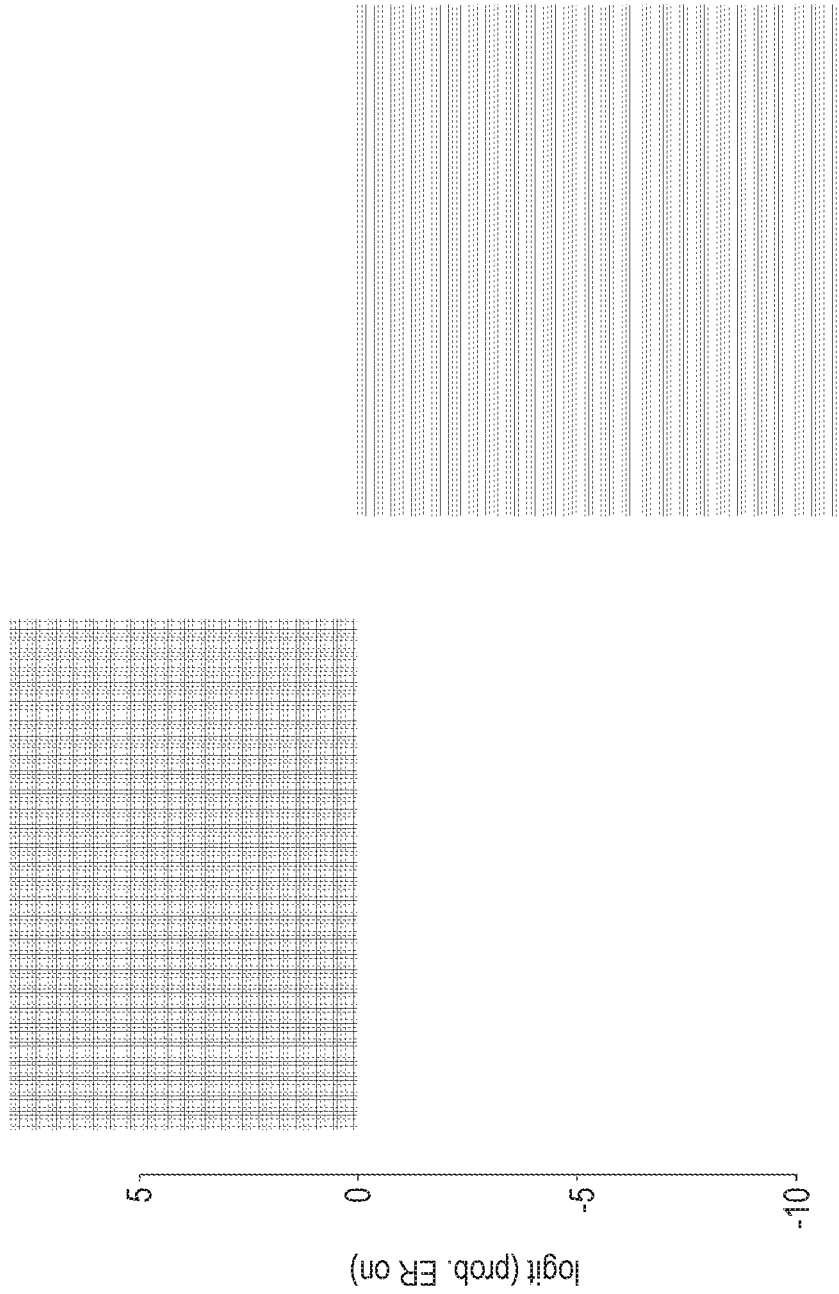

FIG. 36 shows a predicted ER pathway activity in MCF7 cell lines stimulated with estrogen (E2) or a negative control (EtOH) (GSE9253).

Figure 37:
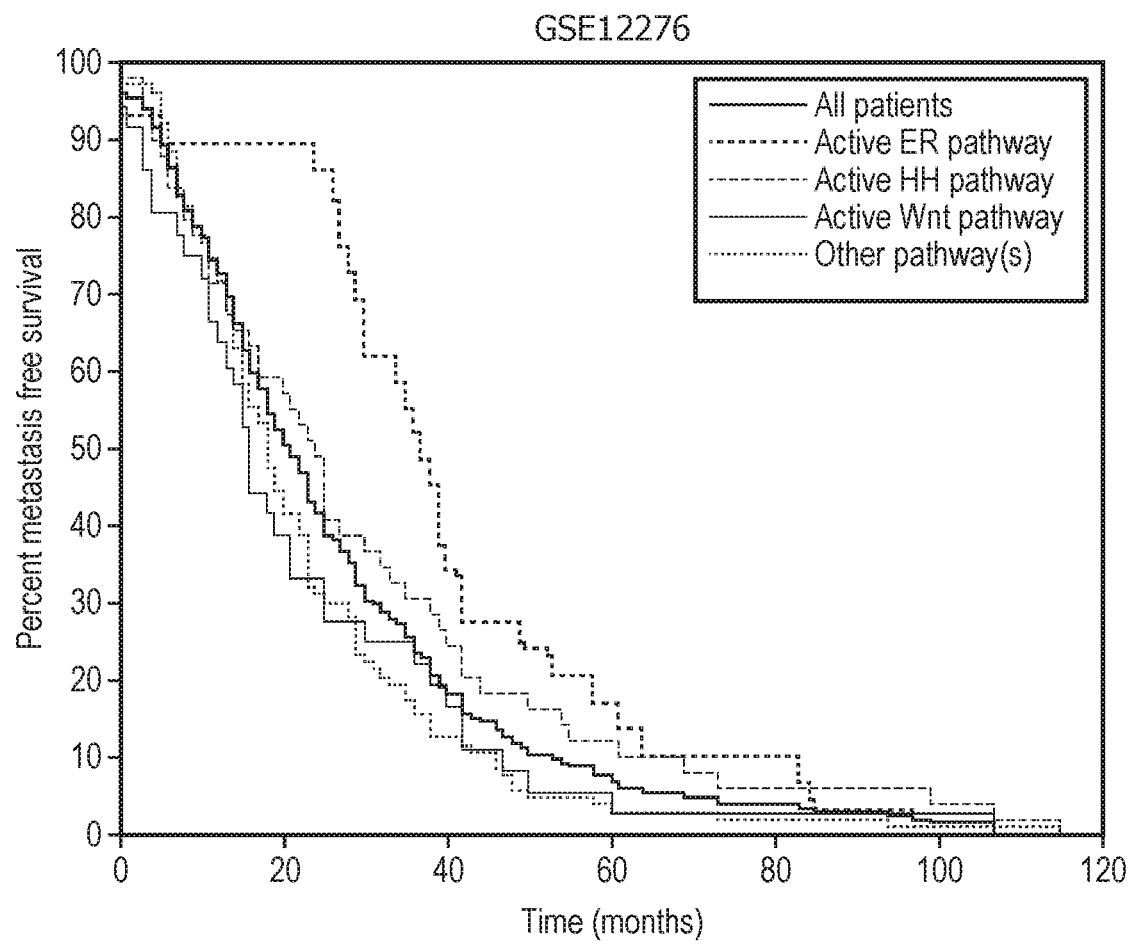

FIG. 37 shows Kaplan-Meier survival curves of patients from the GSE12276 data set grouped according to pathway activity.

Figure 38:
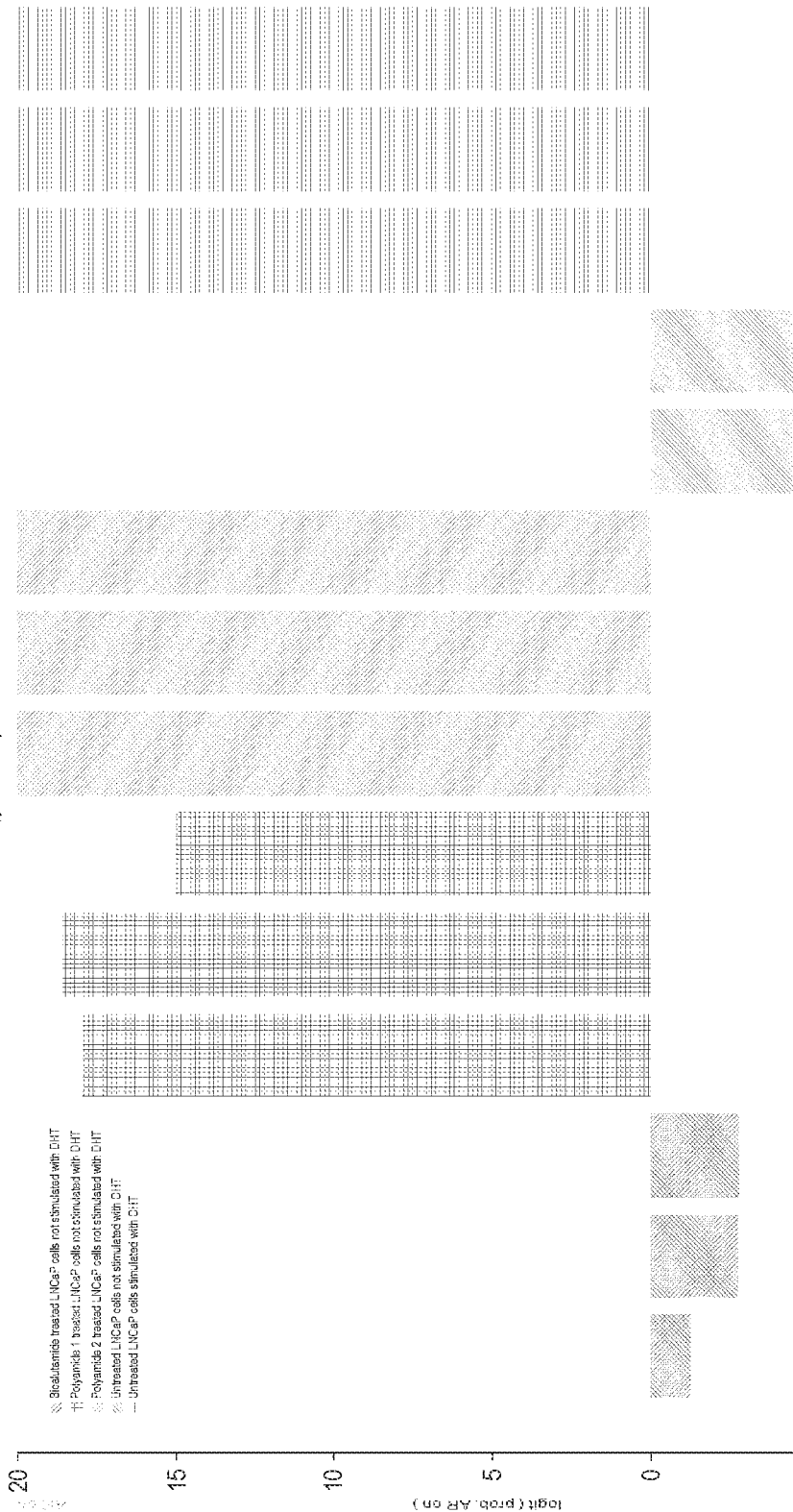

FIG. 38 shows a predicted AR pathway activity in LNCaP cell lines treated with different treatment regimes from GSE7708.

Figure 39:
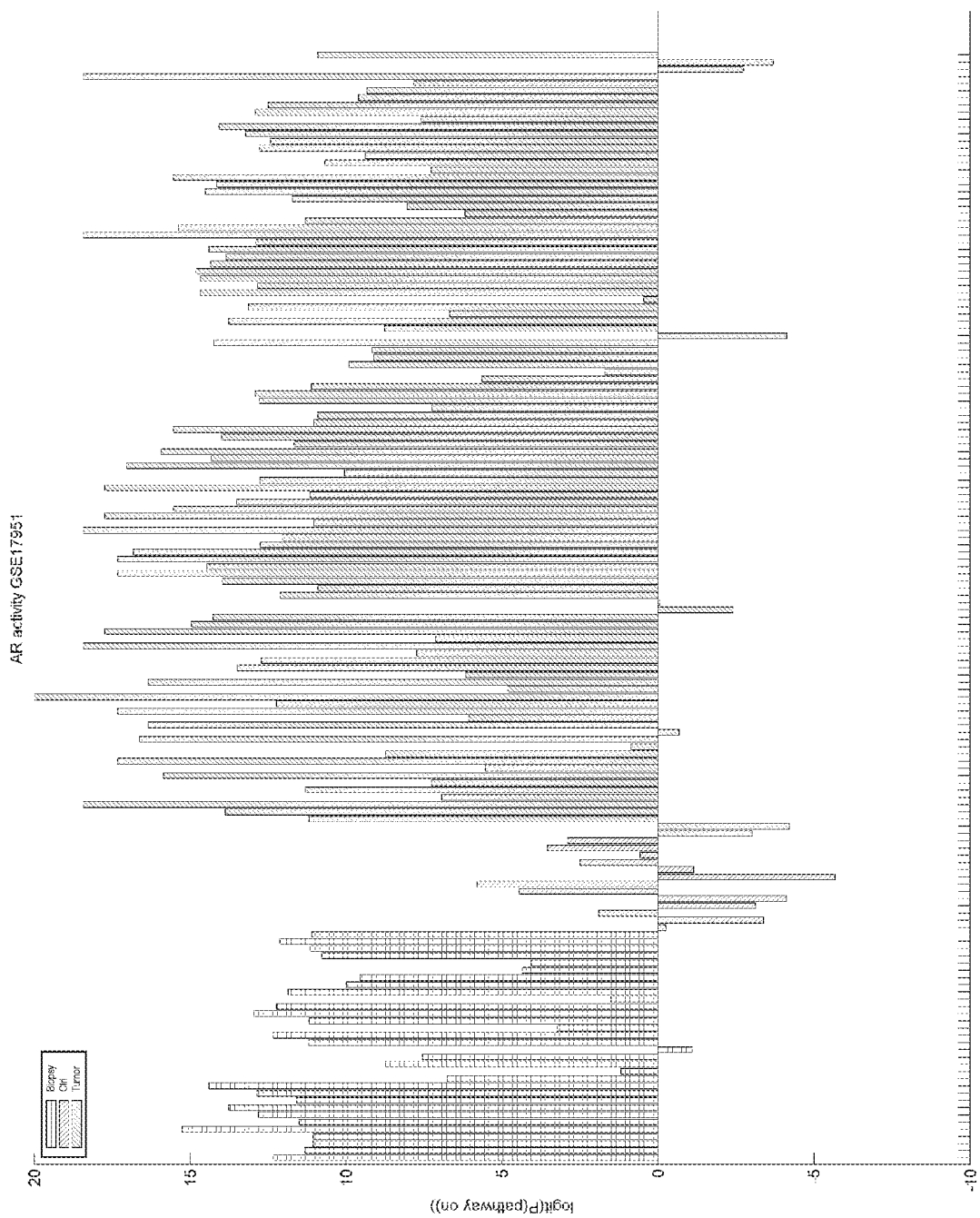

FIG. 39 shows a predicted AR pathway activity in prostate cancer samples from GSE17951.

Figure 40:
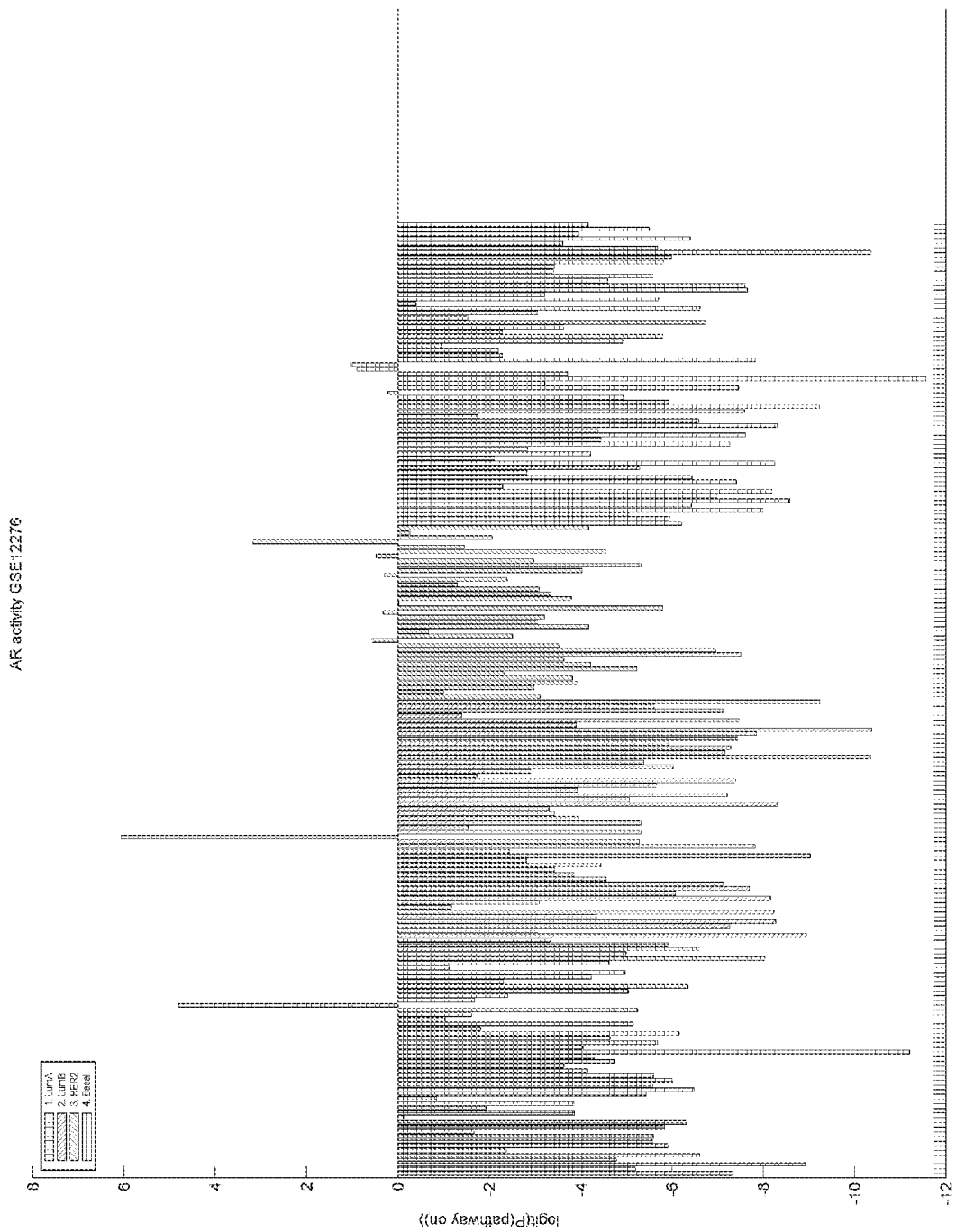

FIG. 40 shows a predicted AR pathway activity in breast cancer samples from GSE12276.

Figure 41:
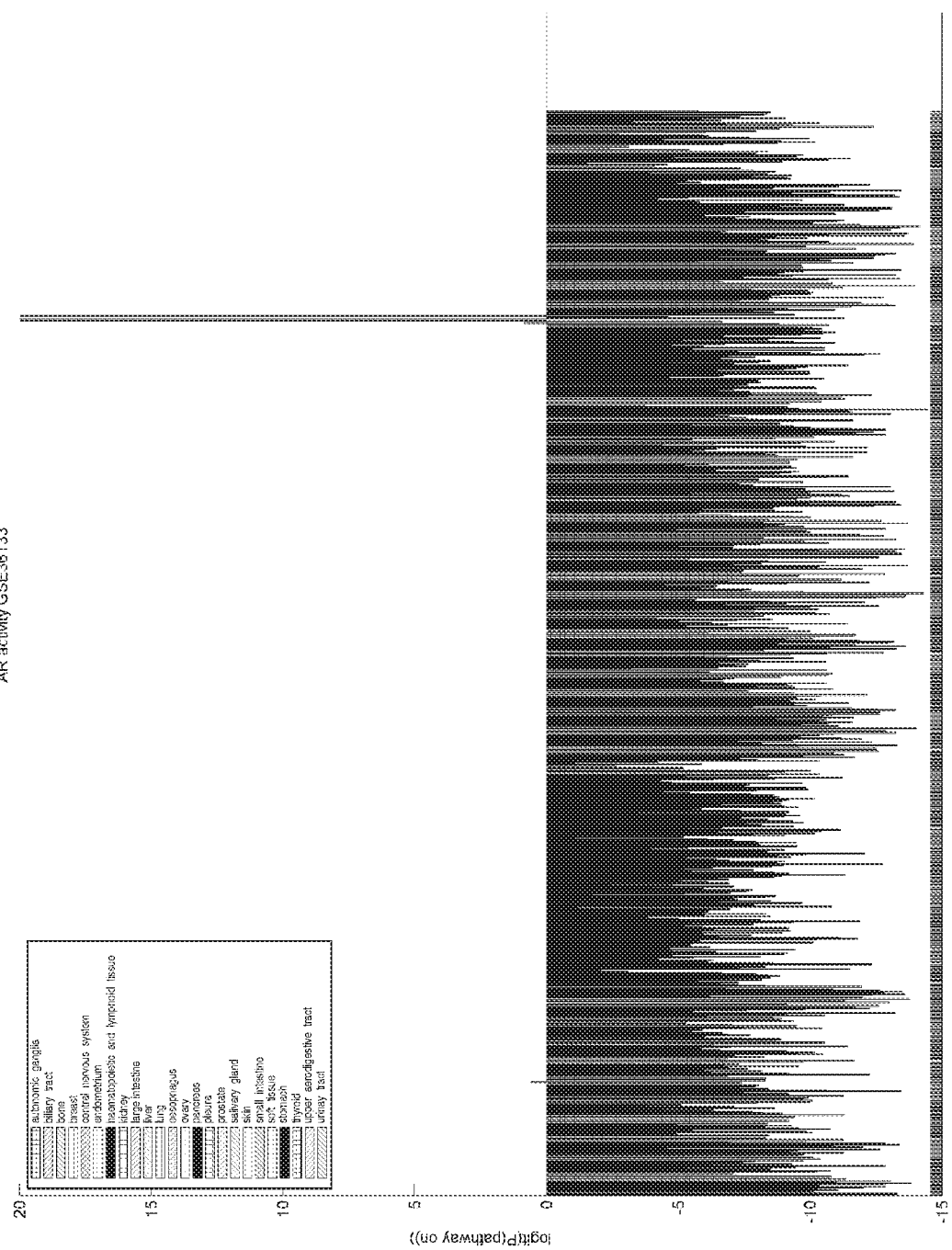

FIG. 41 shows a predicted AR pathway activity in the GSE36133 data set containing cell line samples representing various cancer types.

Figure 42:
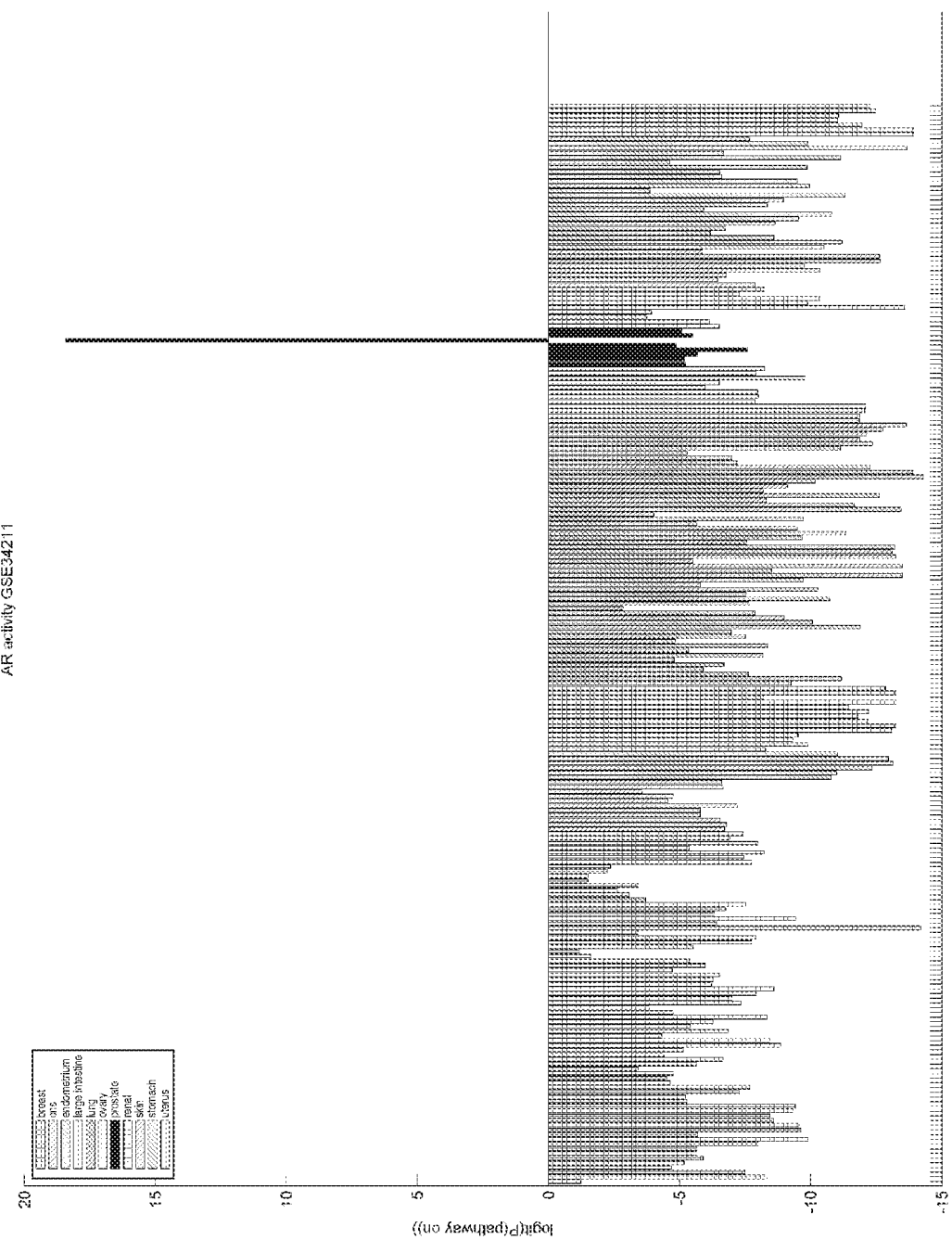

FIG. 42 shows a predicted AR pathway activity in the GSE34211 data set containing cell line samples representing various cancer types.

The following examples merely illustrate particularly preferred methods and selected aspects in connection therewith. The teaching provided therein may be used for constructing several tests and/or kits, e.g. to detect, predict and/or diagnose the abnormal activity of one or more cellular signaling pathways. Furthermore, upon using methods as described herein drug prescription can advantageously be guided, drug prediction and monitoring of drug efficacy (and/or adverse effects) can be made, drug resistance can be predicted and monitored, e.g. to select subsequent test(s) to be performed (like a companion diagnostic test). The following examples are not to be construed as limiting the scope of the present invention.

Example 1: Bayesian Network Construction

As disclosed herein, by constructing a probabilistic model (e.g., the illustrative Bayesian model shown in FIG. 6) and incorporating conditional probabilistic relationships between expression levels of a number of different target genes and the activity of the cellular signaling pathway, such a model can be used to determine the activity of the cellular signaling pathway with a high degree of accuracy. Moreover, the probabilistic model can be readily updated to incorporate additional knowledge obtained by later clinical studies, by adjusting the conditional probabilities and/or adding new nodes to the model to represent additional information sources. In this way, the probabilistic model can be updated as appropriate to embody the most recent medical knowledge.

Figure 1:
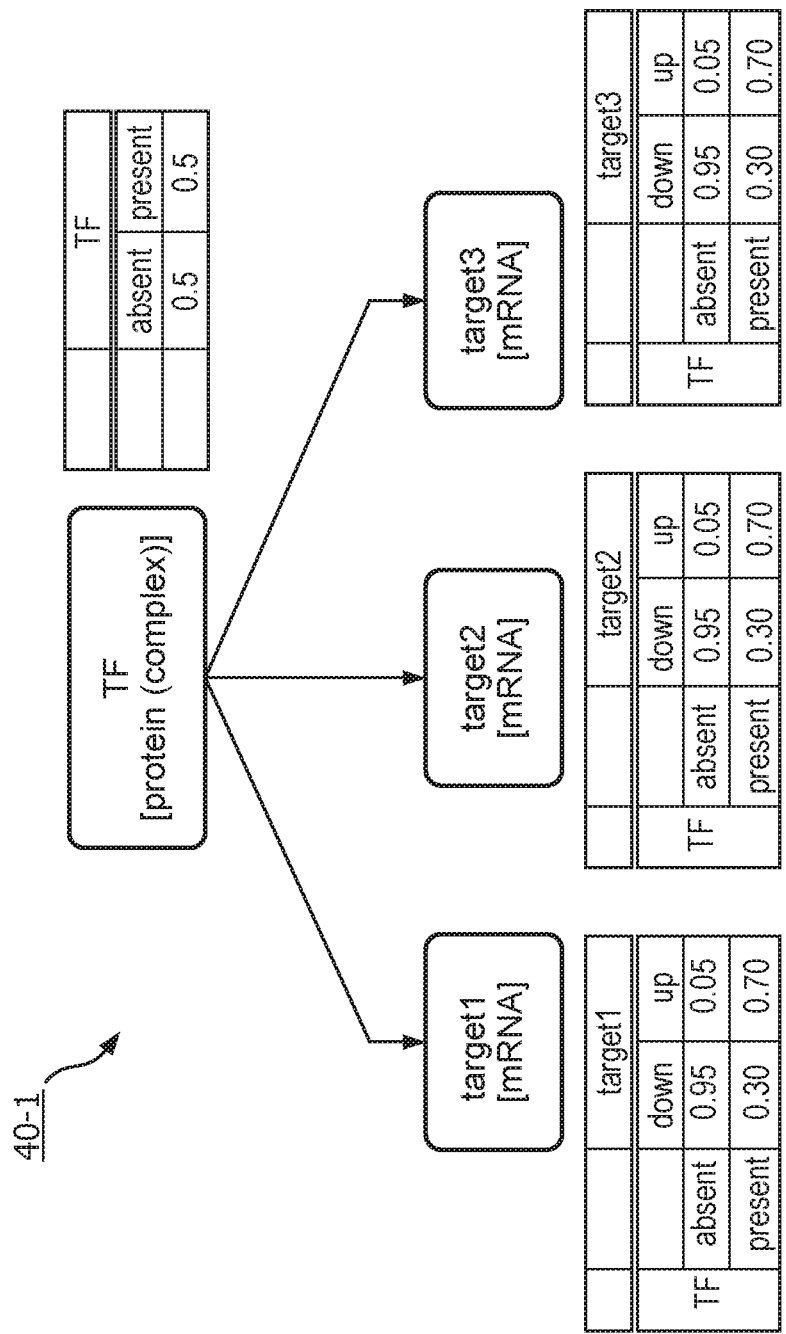

One of the simplest Bayesian network models for representing a cellular signaling pathway would be a two level model including the transcription factor element and the associated target genes (see FIG. 1). The transcription factor complex element is a representation of the level of the transcription factor complex. The protein level of the transcription factor element is connected to a number of mRNA levels of the transcription factor's target genes (in this exemplary Bayesian network only three target genes are depicted, that are known to be expressed in the tissue in case the transcription factor is available). It is to be understood that many, most, or all of the pathway's target genes (in case of the Wnt, ER, Hedgehog and AR pathways particularly the target genes mentioned in Table 1, Table 2, Table 3 and Table 4 respectively) are analogously regulated by the TF element. The relationships between the level of the TF element and the mRNA levels of the target genes are modeled in the Bayesian network by the edges. For each of the target genes, a conditional probabilistic distribution specifies how the gene's mRNA level depends on the level of the TF element.

The levels of the TF element and target genes may be variously represented. One option is to use a binary discretization, into states "absent" and "present" for the TF element, and "down" and "up" for a target gene's mRNA level (see FIG. 1). The probabilistic relationship between the TF element and a target gene can then be represented by a conditional probability table (as indicated in the same figure). Instead of a binary discretization, levels can also represented as continuous level values, or as quantized values having three or more quantization levels (e.g. "down", "normal" and "up" for target genes).

The foregoing illustration of a simple Bayesian network is just an illustrative embodiment of the Bayesian network model (FIG. 1). In general, a Bayesian network model comprises a directed, acyclic graph comprising nodes connected by edges. Each node represents an information item pertaining to the pathway at hand (or, more generally, to the cellular signaling pathway). Pathway element nodes each represent a genomic or proteomic element of the cellular signaling pathway. By way of illustrative example, a pathway element node may represent one of but not restricted to: a protein, a protein complex, an mRNA molecule transcribed from a target gene of the cellular signaling pathway, a methylated gene, a phosphorylated protein, a phosphorylated protein complex, or so forth. As discussed later herein, several other types of nodes, but not limited to the examples given, may be included in the Bayesian network to represent other types of information such as specific measurement datum elements, gene variation occurrences, or so forth.

Figure 2:
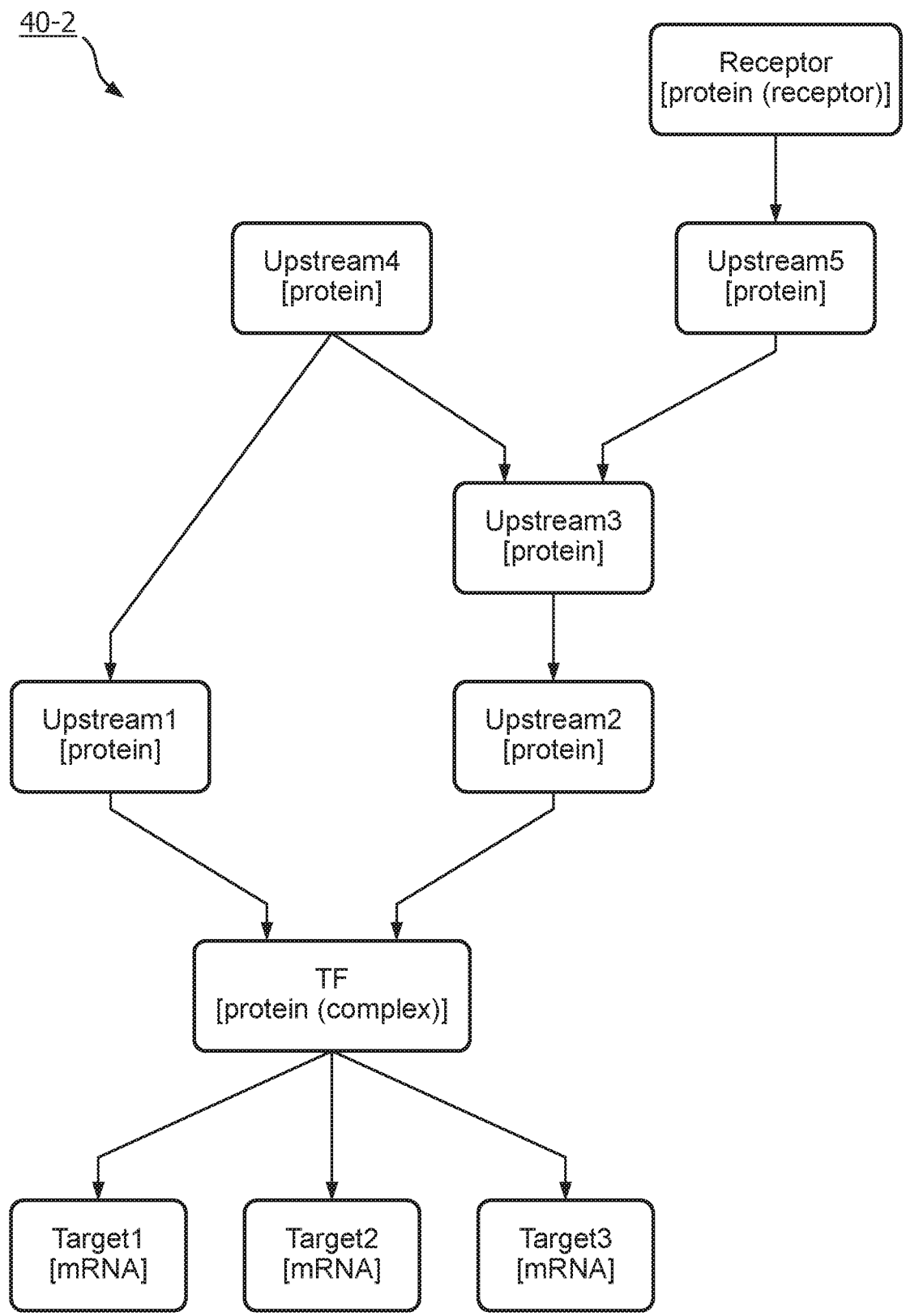
Figure 3:
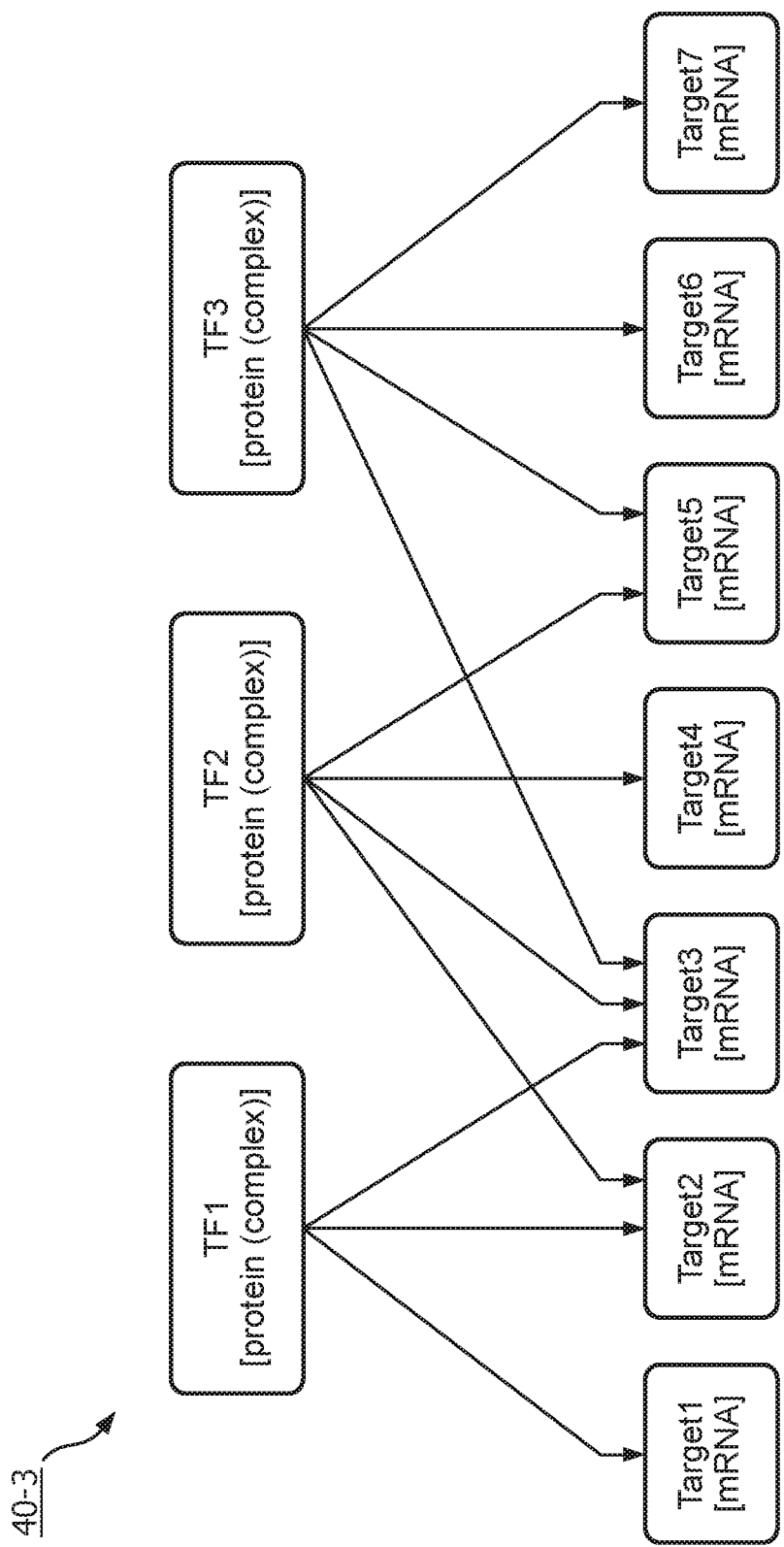
FIG. 3 shows an illustrative example of a Bayesian network representation of a single cellular signaling pathway with multiple transcription factor complex or a multiple cellular signaling pathways with their own transcription factor complex combined into one Bayesian network or a combination thereof.

Additional "upstream" levels representing regulatory proteins (in active or inactive state) of the pathway are typically added if knowledge of the level of such a protein could be probative for determining the clinical decision support recommendation. For example, the inclusion of the proteins elementary to the transcription factor or essential proteins upstream of the transcription factor in the Bayesian network (see FIG. 2) could be useful if a drug is available that specifically targets such proteins, rather than the pathway as a whole. The transcription factor (TF) element is believed to be a protein complex (that is, a combination of proteins bound together in a specific structure that performs the function of regulating transcription from the target genes) in the majority of the signaling pathways. For other pathways, the TF element may be a single protein. In addition, signaling pathways may exert their activity through more than one transcription factor resulting in a more complex Bayesian network with multiple transcription factors feeding into the target gene(s) (see FIG. 3 for a hypothetical illustration of multiple transcription factor elements influencing target gene transcription). Such a multi-transcription factor Bayesian network may also be the result of a combination of pathways combined in one Bayesian network.

Figure 4:
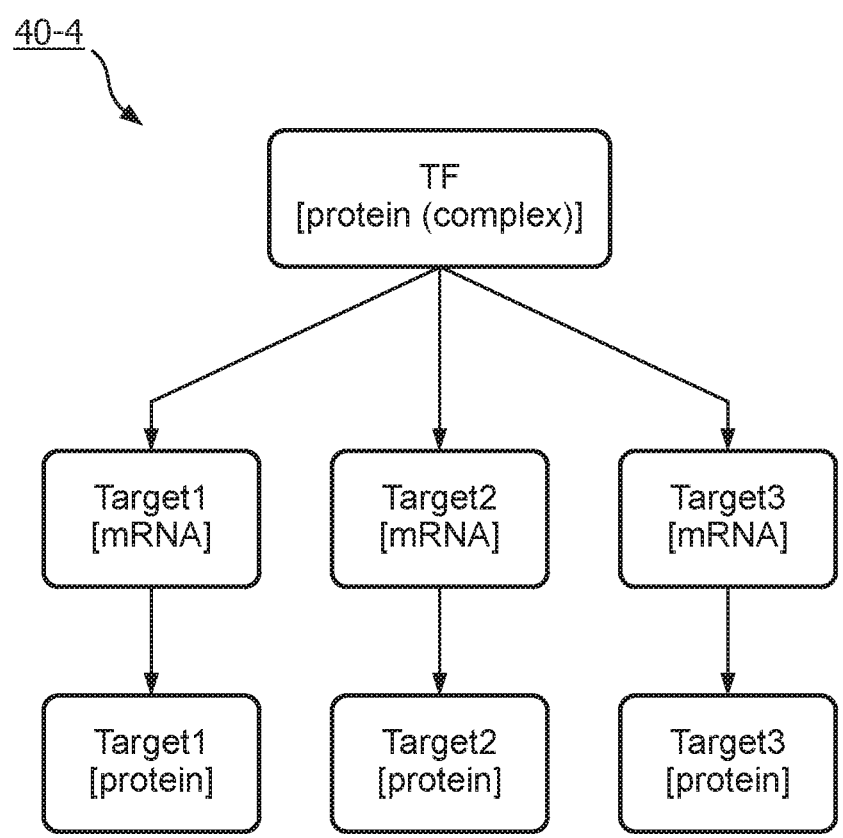
FIG. 4 shows an example of a Bayesian network illustrating a simple representation of a cellular signaling pathway similar to FIG. 1. Now additional nodes have been attached to represent the translation of target mRNA into target proteins.
Figure 5:
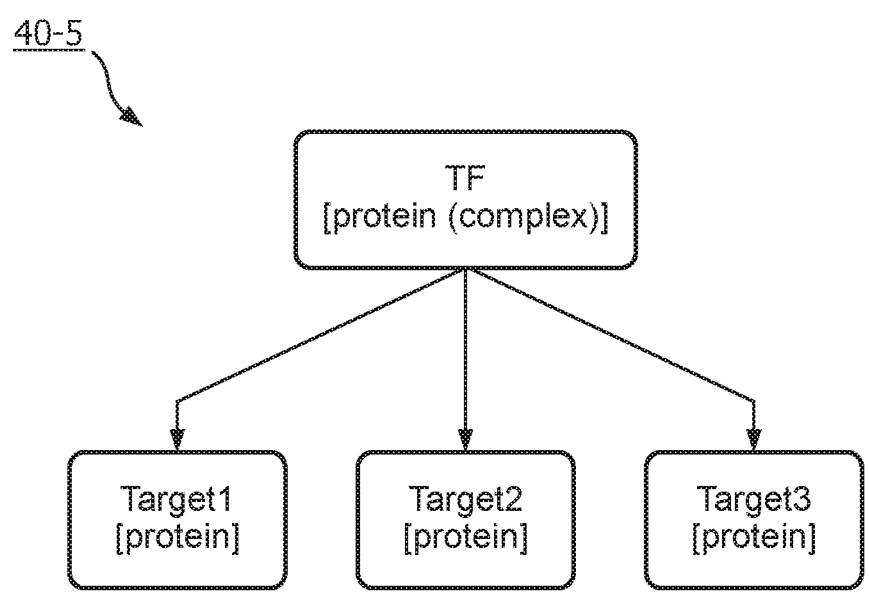
FIG. 5 shows an illustrative of a Bayesian network illustrating another simple representation of a cellular signaling pathway. The pathway is represented using the transcription factor complex and its target protein levels.

Additional information nodes further downstream of the target genes may be included in the Bayesian network as well. An illustrative example of this is the translation of target gene's mRNA into proteins (FIG. 4) or protein level nodes of the target gene as surrogate node of the target gene's mRNA level (FIG. 5). The mRNA molecules of the target gene are translated by interaction with ribosome molecules to form proteins corresponding to the mRNA molecules and corresponding to the target genes. This is expression of the target genes at the protein level. Measurement of the protein level by, but not limited to, for example mass-spectrometry, immunohistochemistry, gel electrophoresis techniques may act as evidence for these target protein levels.

The expression level of a target gene may be computed based on the measured intensity of corresponding probesets of a microarray, for example by averaging or by other means of other techniques (e.g. RNA sequencing). In some embodiments this computation is integrated into the Bayesian network, by extending the Bayesian network with a node for each probeset that is used and including an edge running to each of these "measurement" nodes from the corresponding target gene node, as described herein with reference to FIG. 6.

Figure 7:
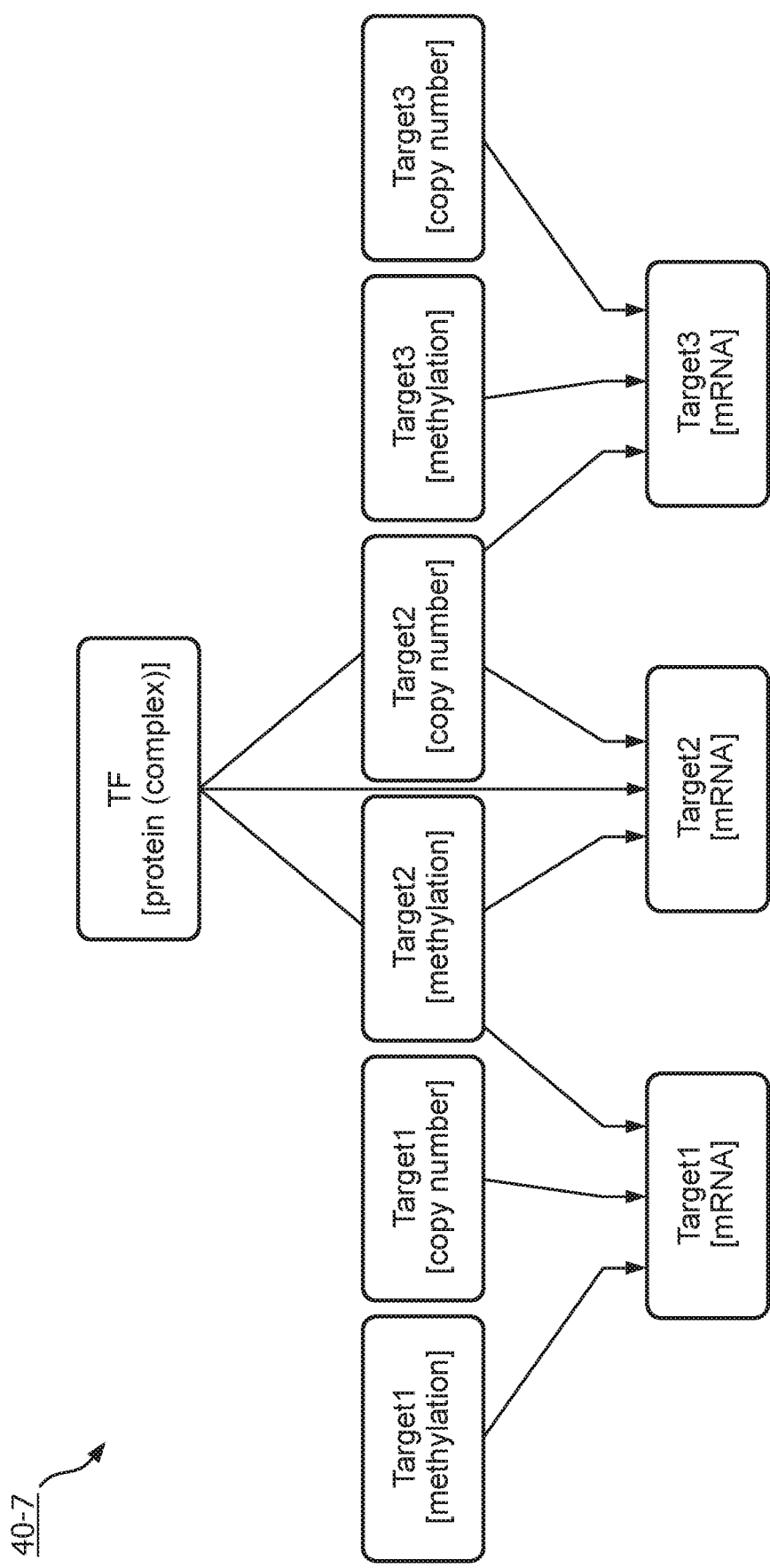
FIG. 7 shows an illustrative example of a variant embodiment of the Bayesian network of FIG. 1 which includes nodes representing methylation and copy number variations as examples for additional information nodes for in this particular example any of the included target mRNA levels.
Figure 8:
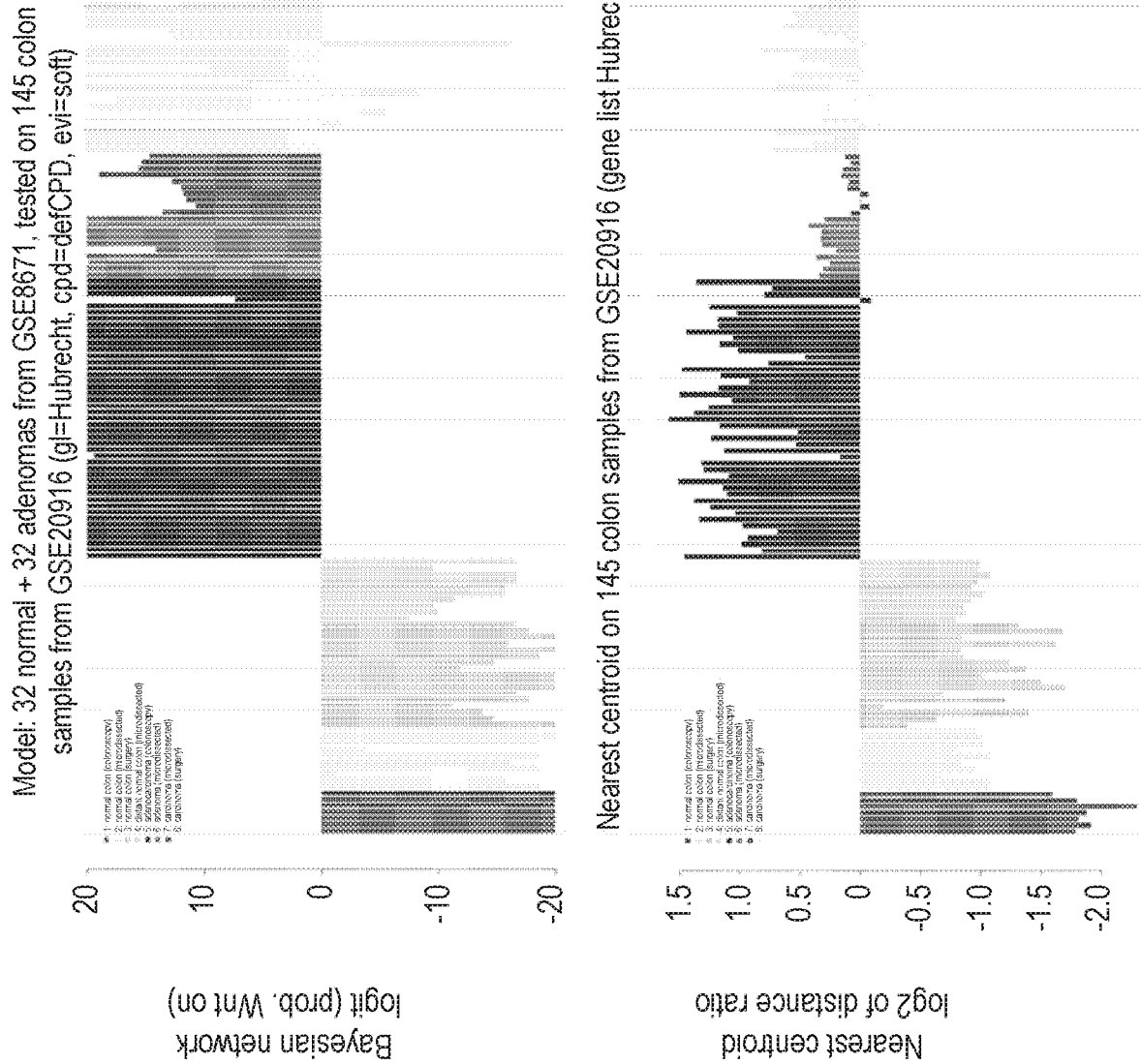
FIG. 8 shows a predicted Wnt pathway activity of the Bayesian network and nearest centroid method as described herein in a data set of colon samples (GSE20916).
Figure 9:
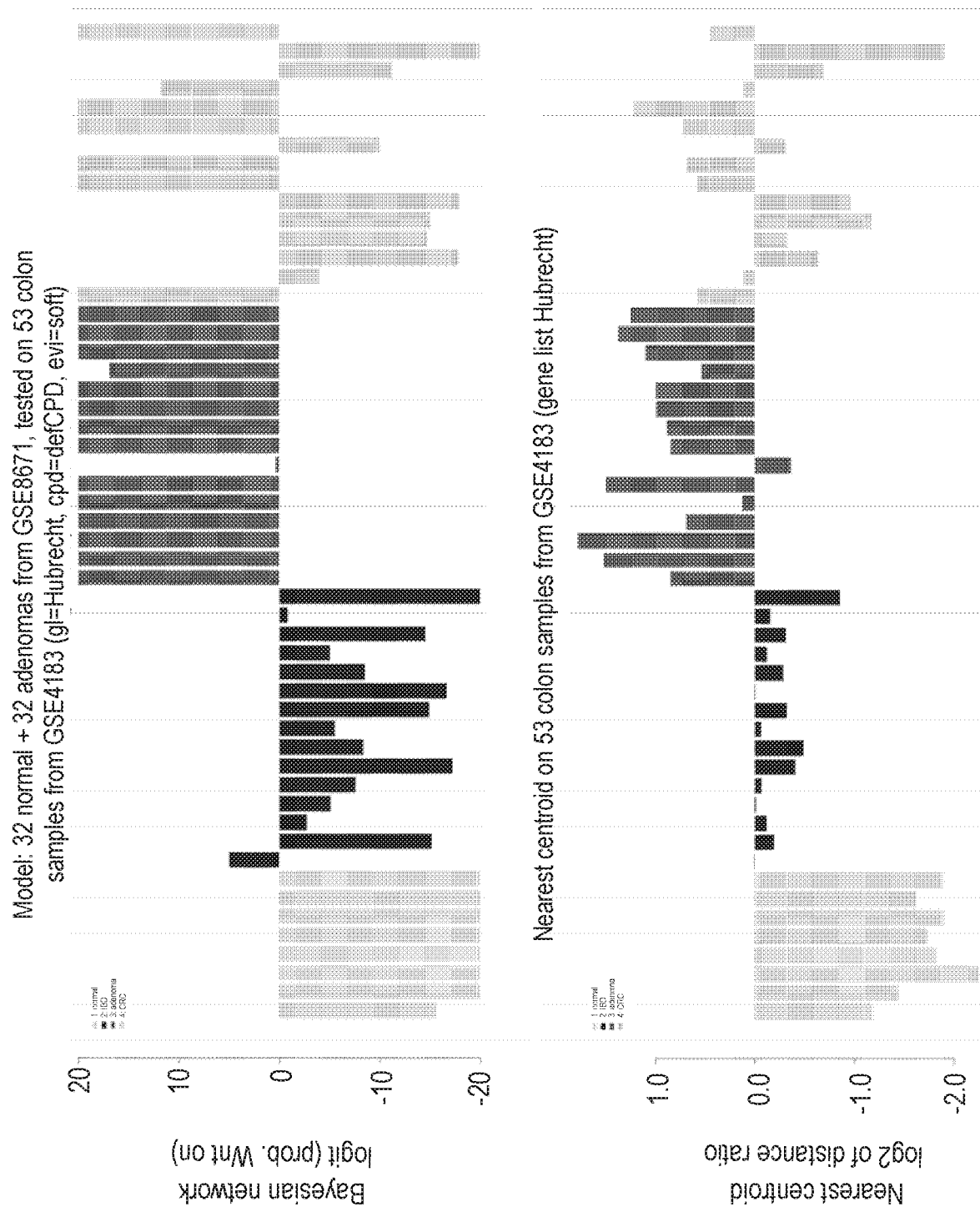
FIG. 9 shows a predicted Wnt pathway activity of the Bayesian network and nearest centroid method as described herein in a data set of colon samples (GSE4183).
Figure 10:
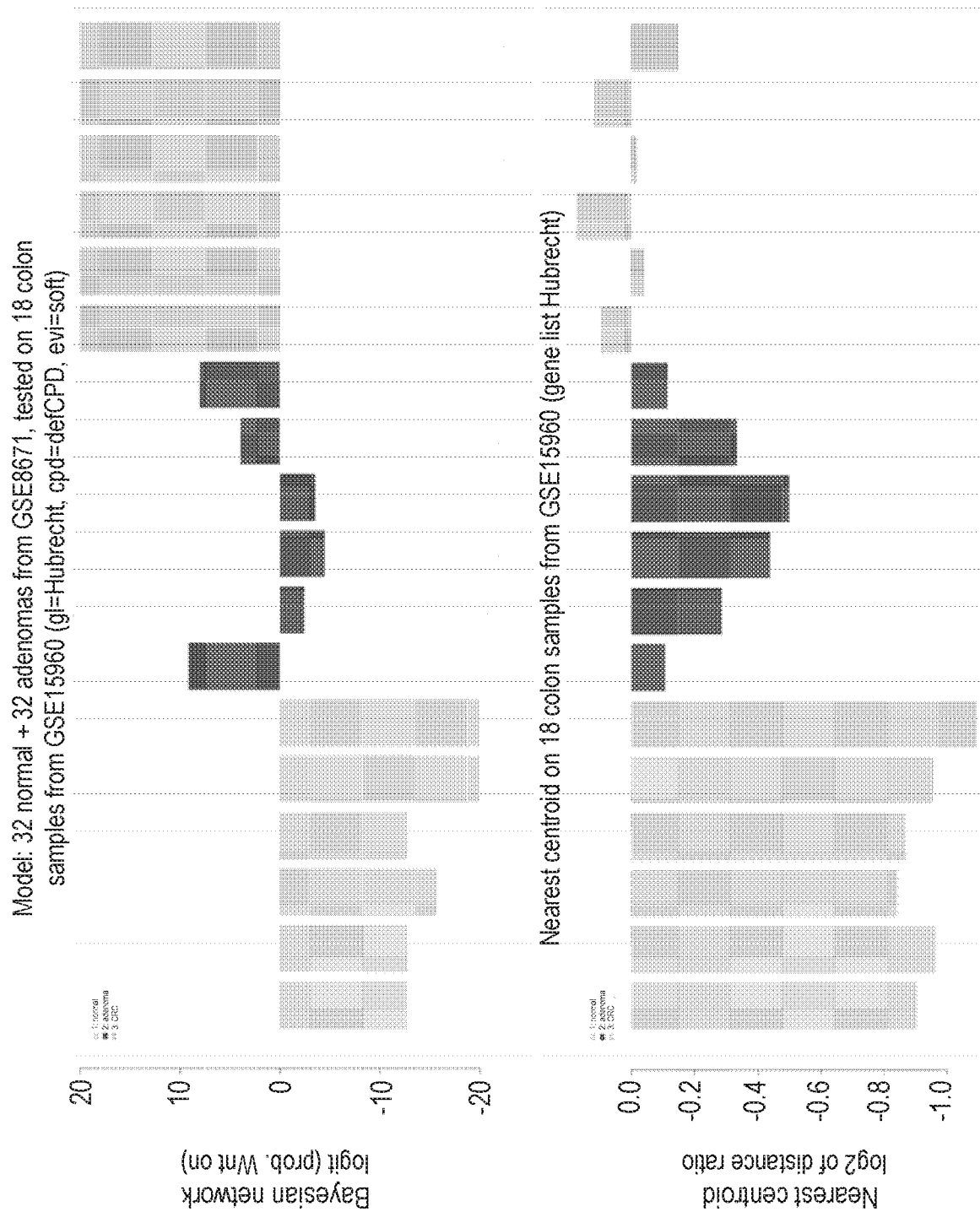
FIG. 10 shows a predicted Wnt pathway activity of the Bayesian network and nearest centroid method as described herein in a data set of colon samples (GSE15960).
Figure 11:
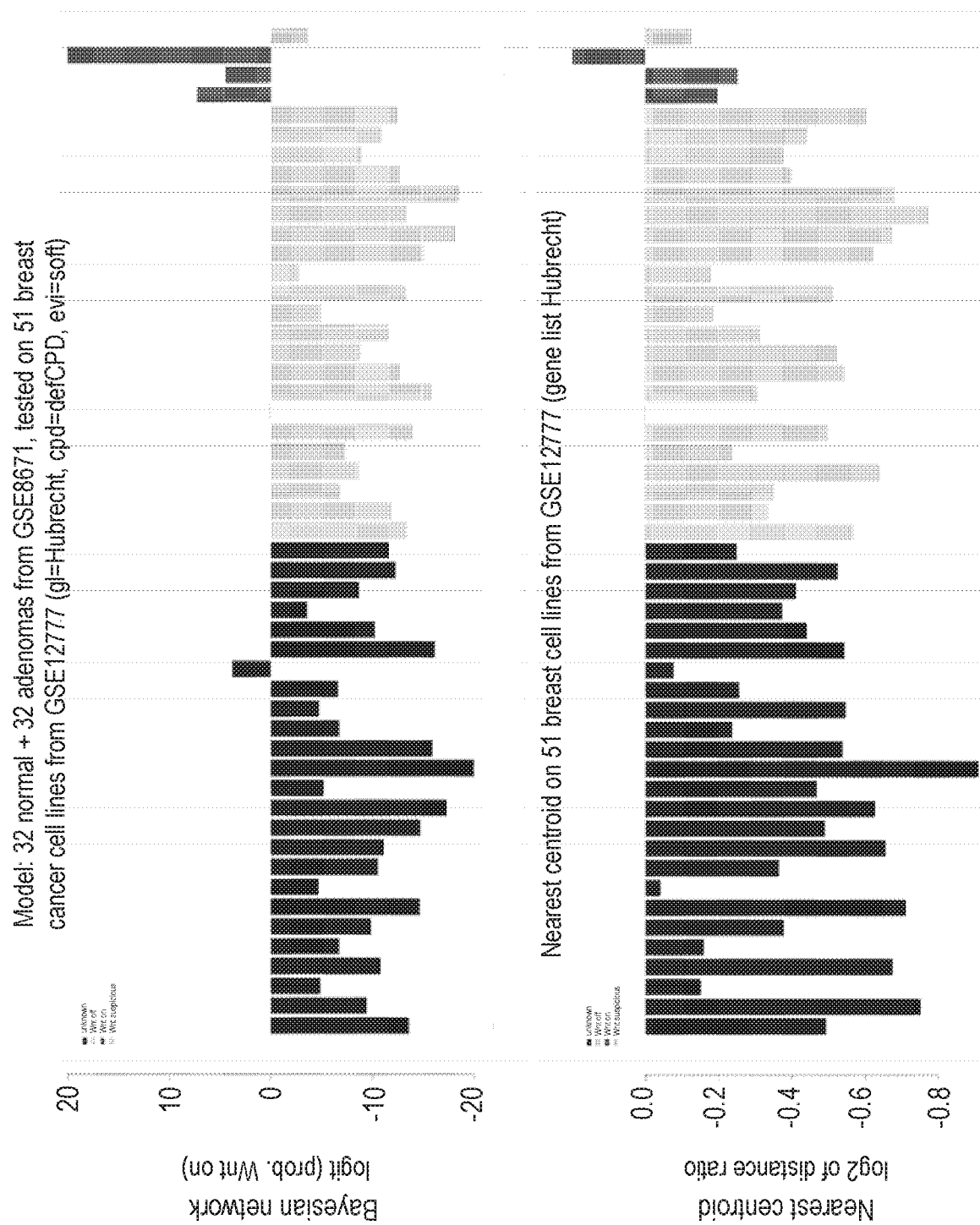
FIG. 11 shows a predicted Wnt pathway activity of the Bayesian network and nearest centroid method as described herein in a data set of breast cancer samples (GSE12777).
Figure 12:
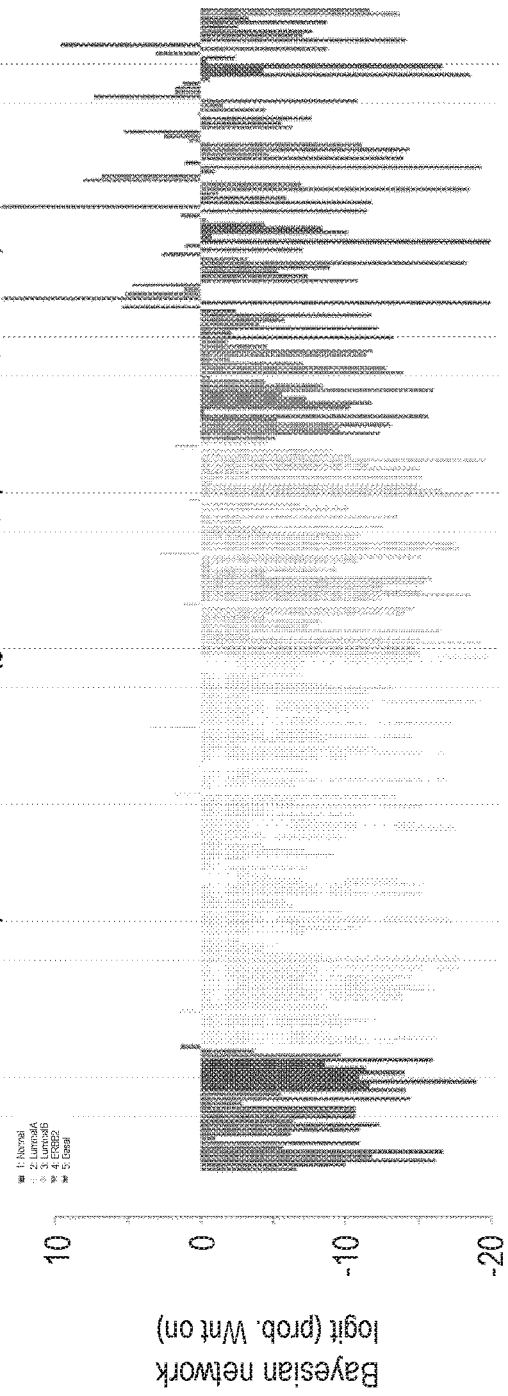
FIG. 12 shows a predicted Wnt pathway activity of the Bayesian network and nearest centroid method as described herein in a data set of breast cancer samples (GSE21653).
Figure 12:
Figure 13:
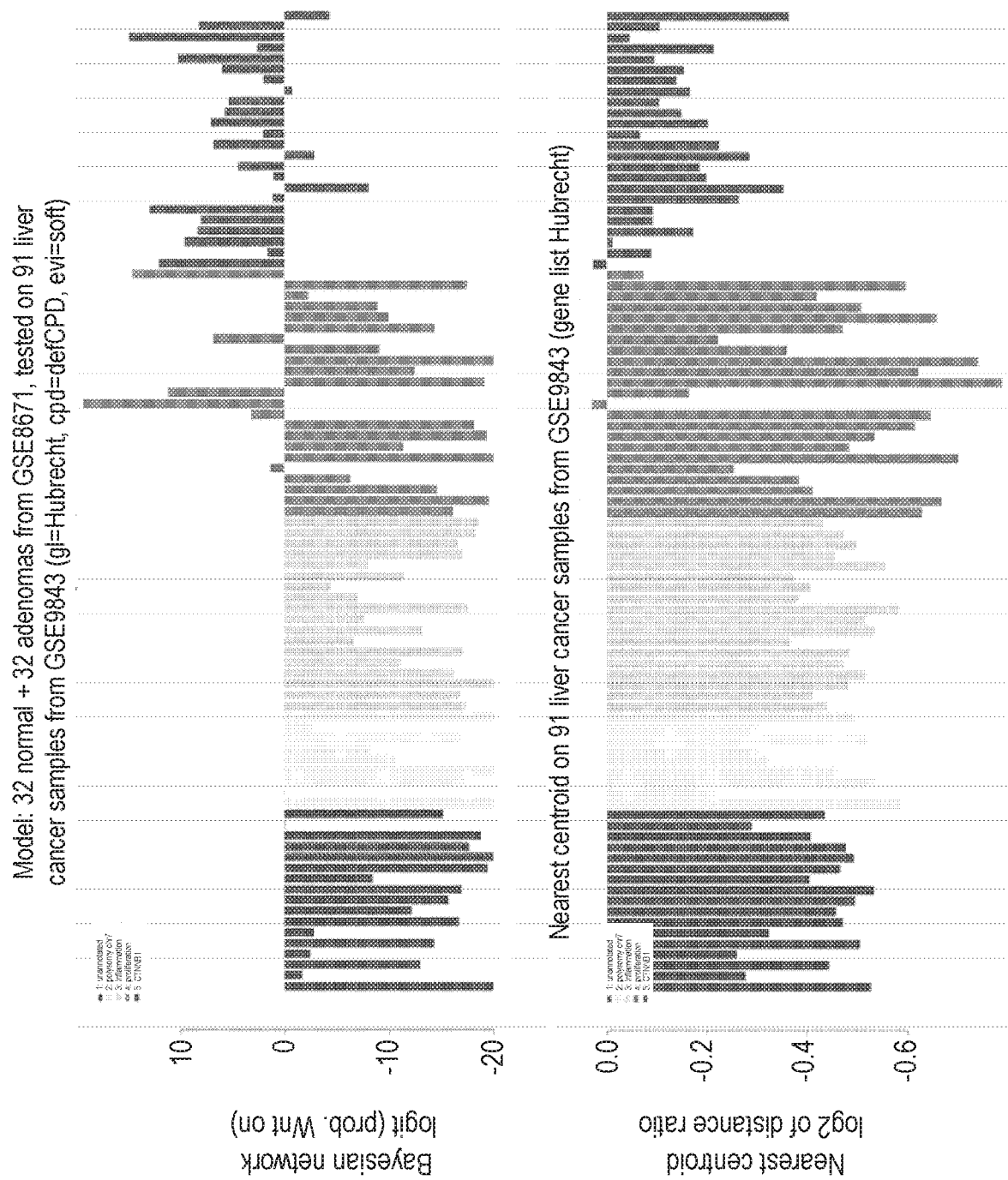
FIG. 13 shows a predicted Wnt pathway activity of the Bayesian network and nearest centroid method as described herein in a data set of liver cancer samples (GSE9843).
Figure 14:
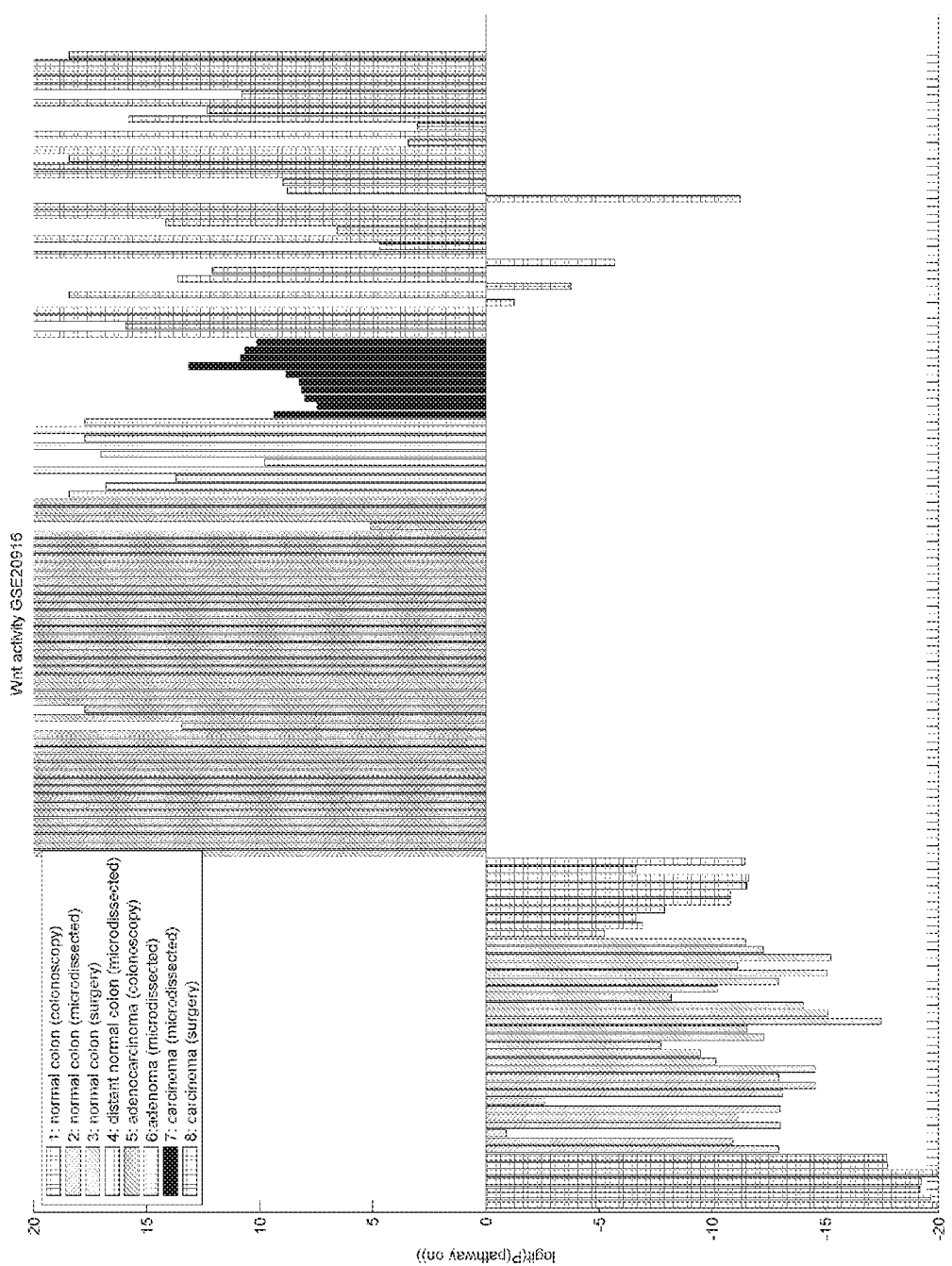
FIG. 14 shows a predicted Wnt pathway activity using a Bayesian network using the target genes of the evidence curated list compared to the target genes of the broad literature list as described herein in a data set of colon samples (GSE20916).
Figure 14:
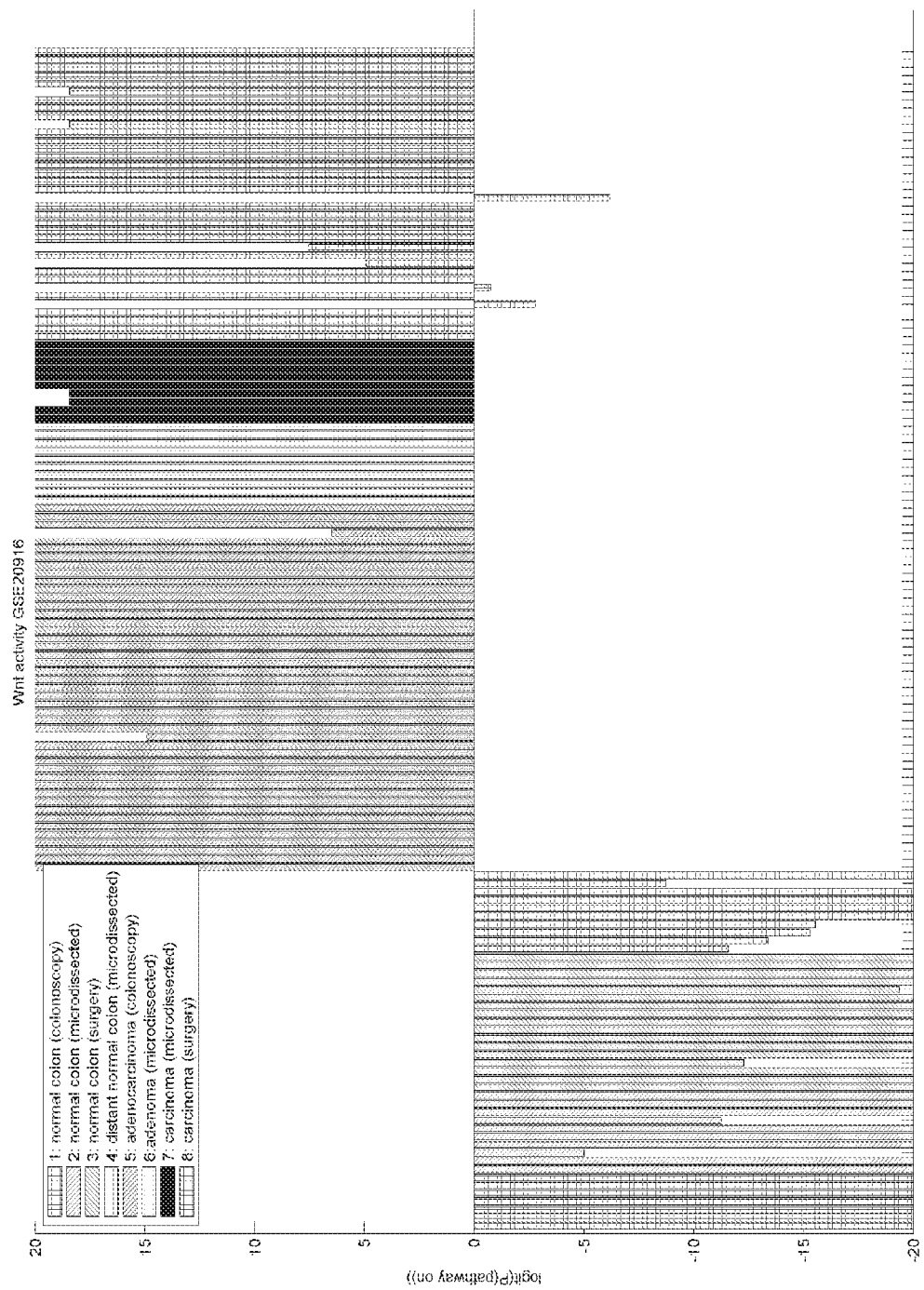
Figure 15:
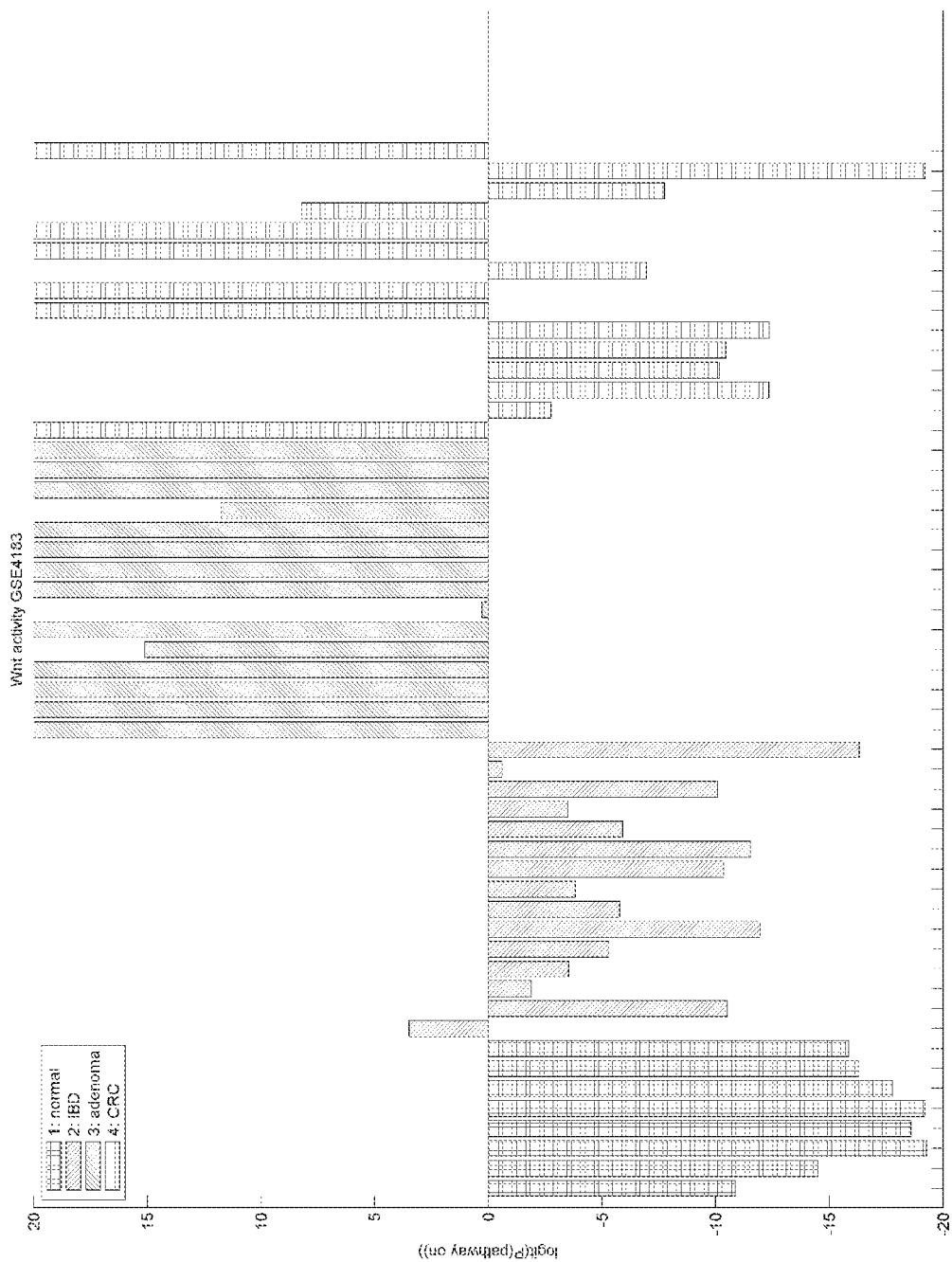
FIG. 15 shows a predicted Wnt pathway activity using a Bayesian network using the target genes of the evidence curated list compared to the target genes of the broad literature list as described herein in a data set of colon samples (GSE4183).
Figure 16:
FIG. 16 shows a predicted Wnt pathway activity using a Bayesian network using the target genes of the evidence curated list compared to the target genes of the broad literature list as described herein in a data set of colon samples (GSE15960).
Figure 17:
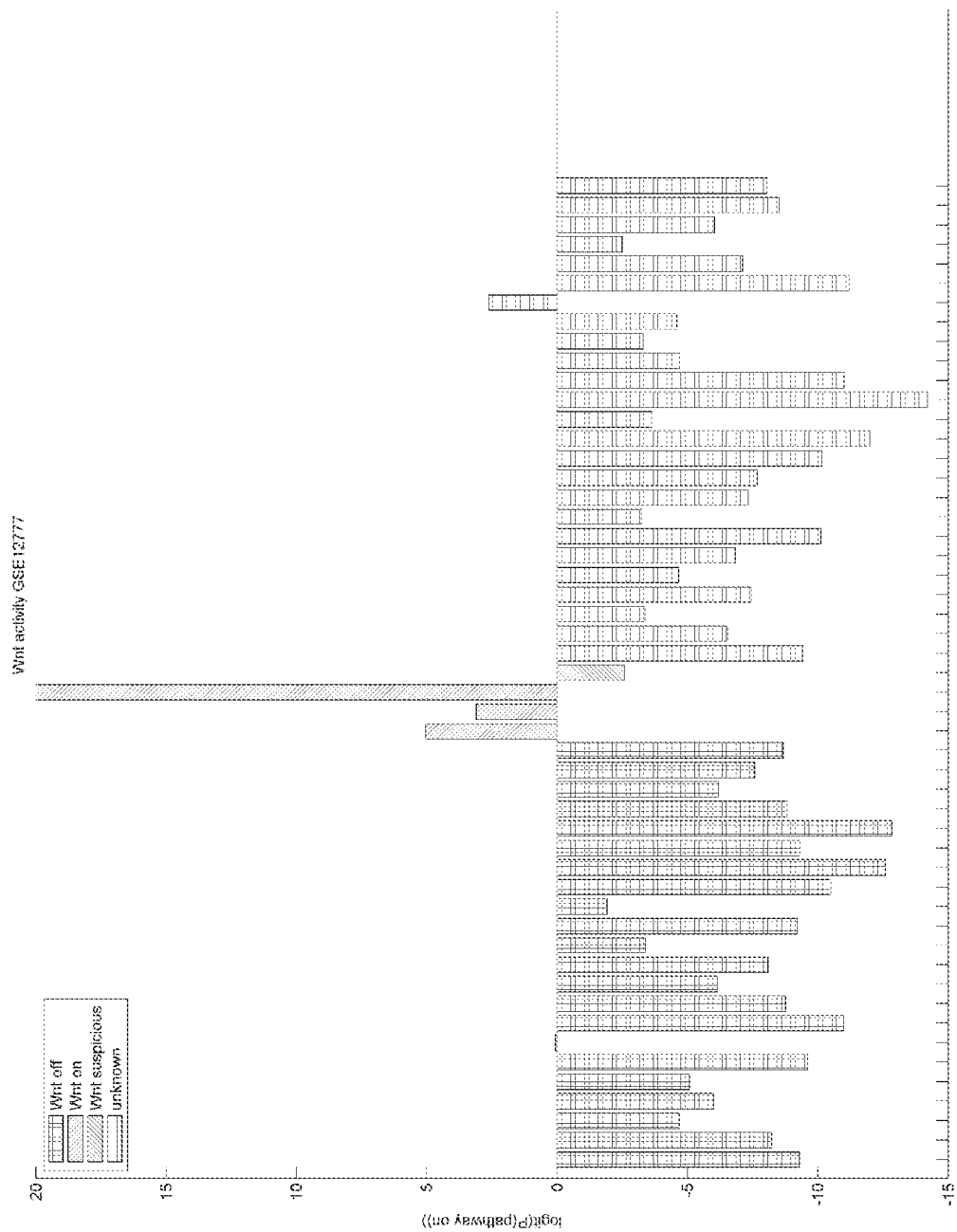
FIG. 17 shows a predicted Wnt pathway activity using a Bayesian network using the target genes of the evidence curated list compared to the target genes of the broad literature list as described herein in a data set of breast cancer samples (GSE12777).
Figure 17:
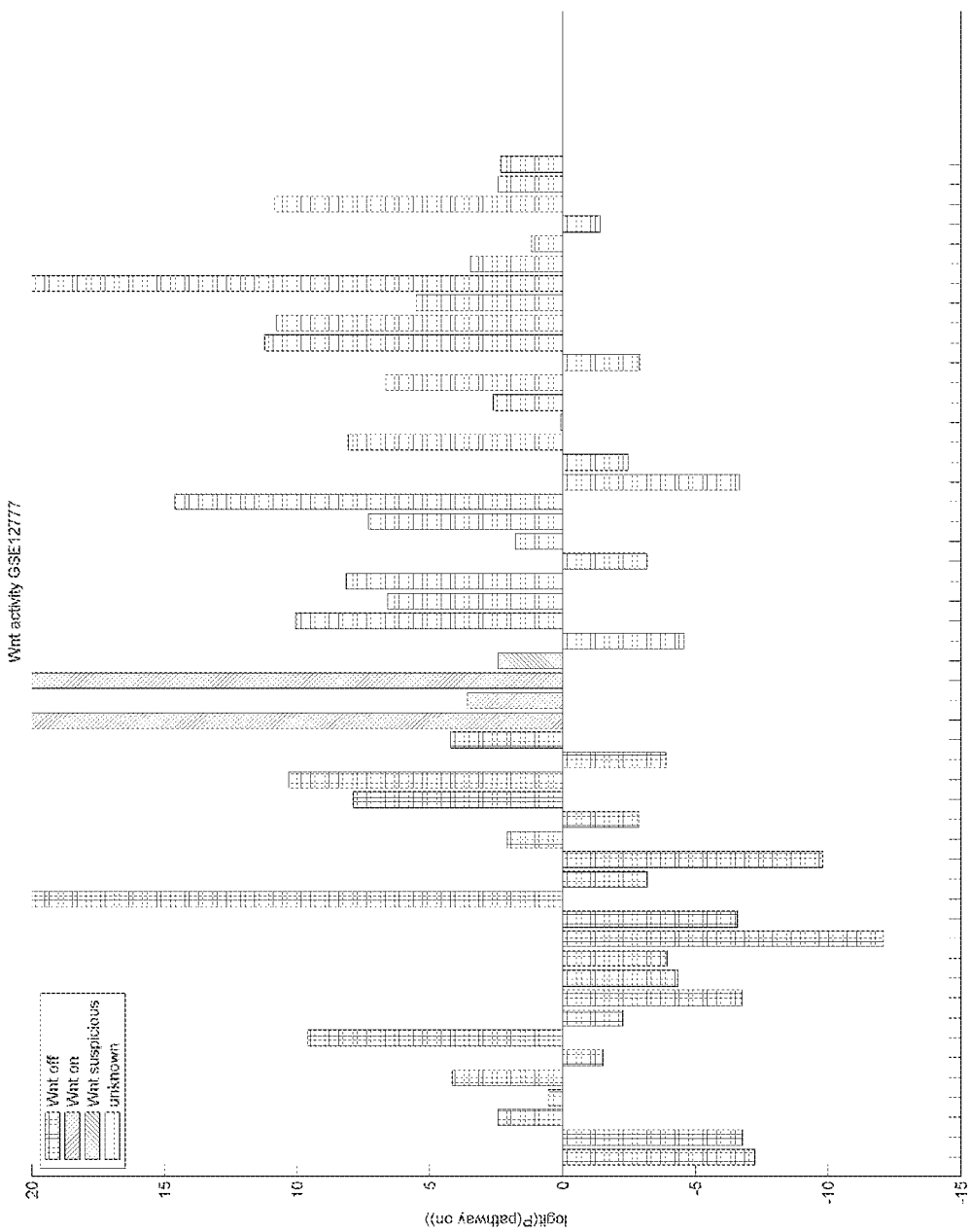
Figure 18:
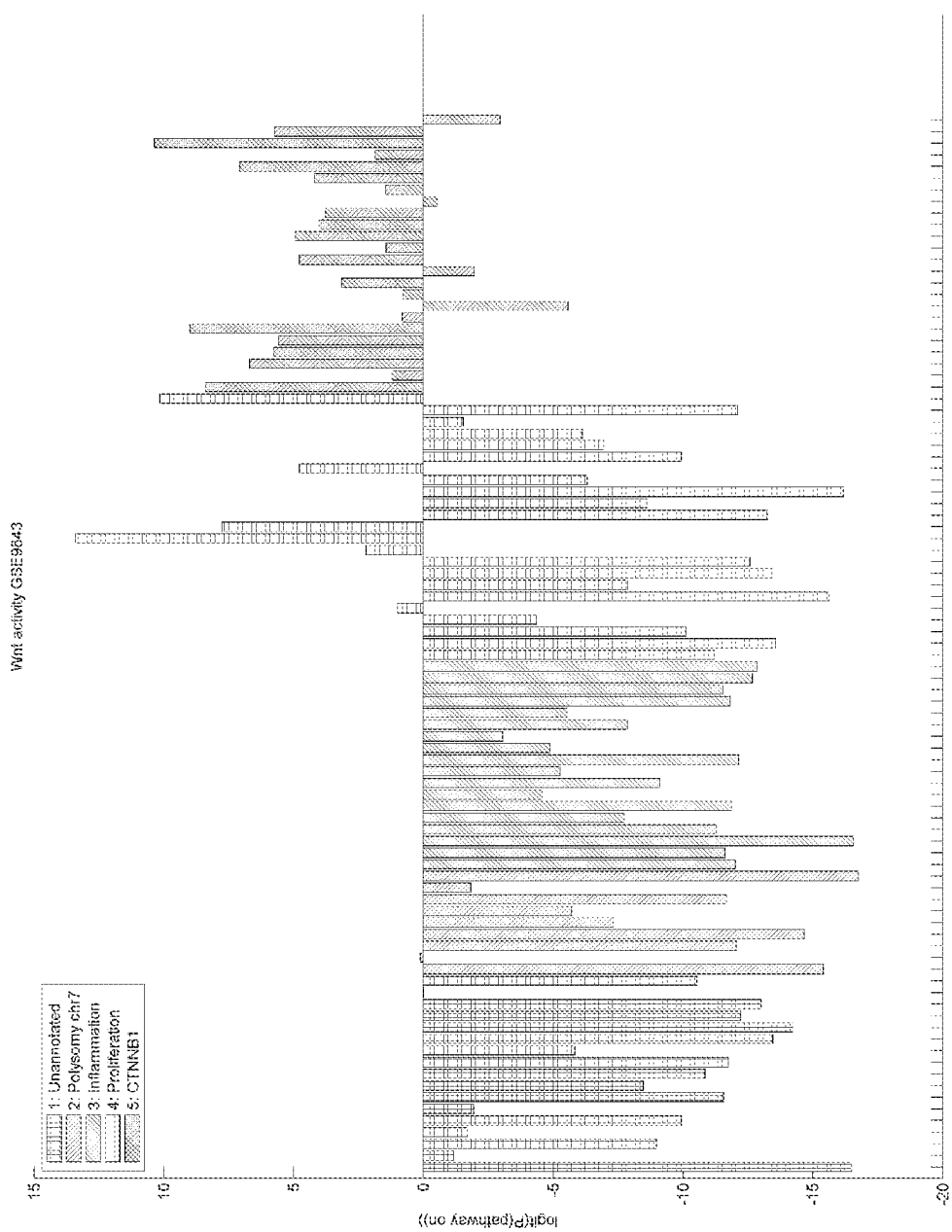
FIG. 18 shows a predicted Wnt pathway activity using a Bayesian network using the target genes of the evidence curated list compared to the target genes of the broad literature list as described herein in a data set of liver cancer samples (GSE9843).
Figure 18:
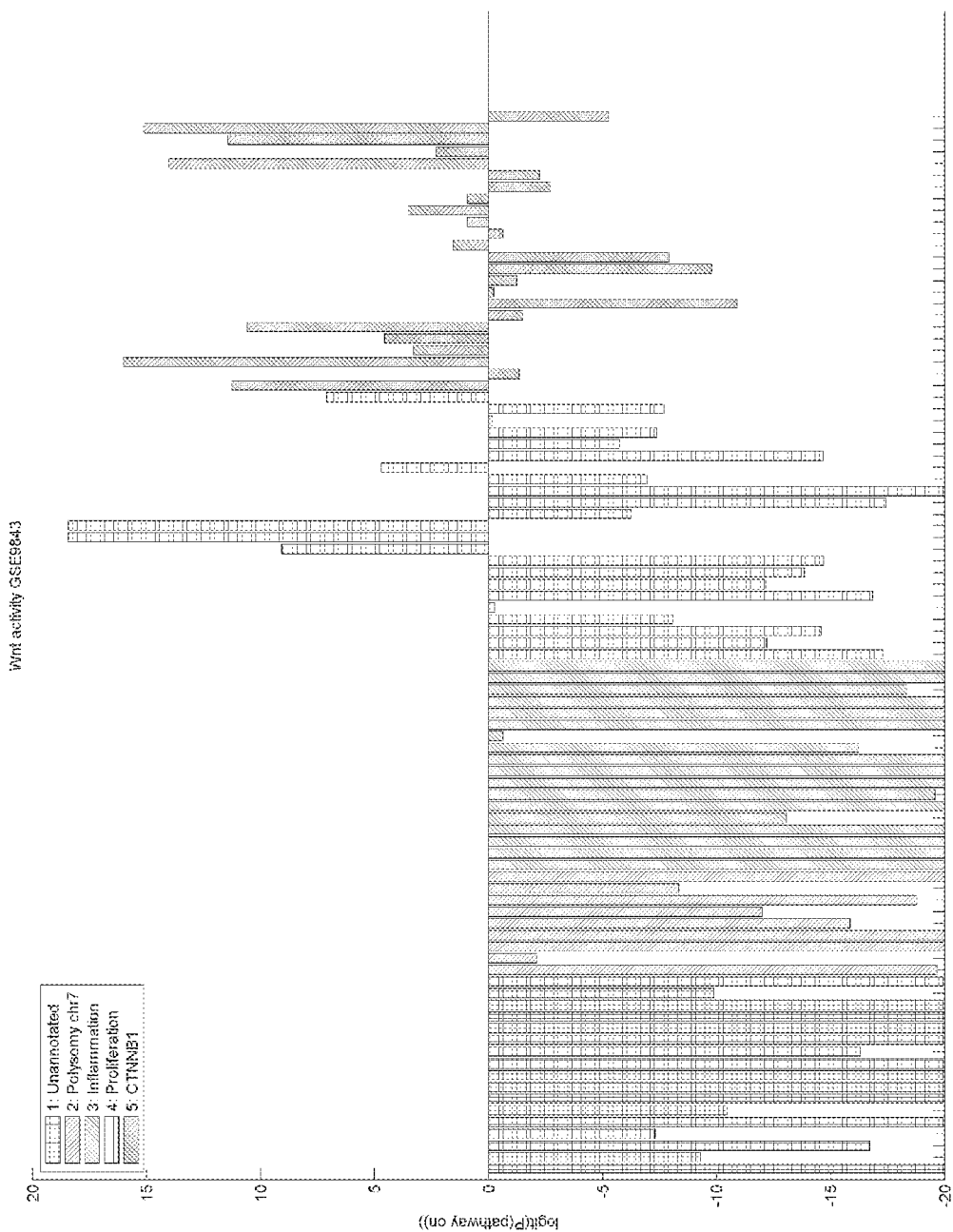
Figure 19:
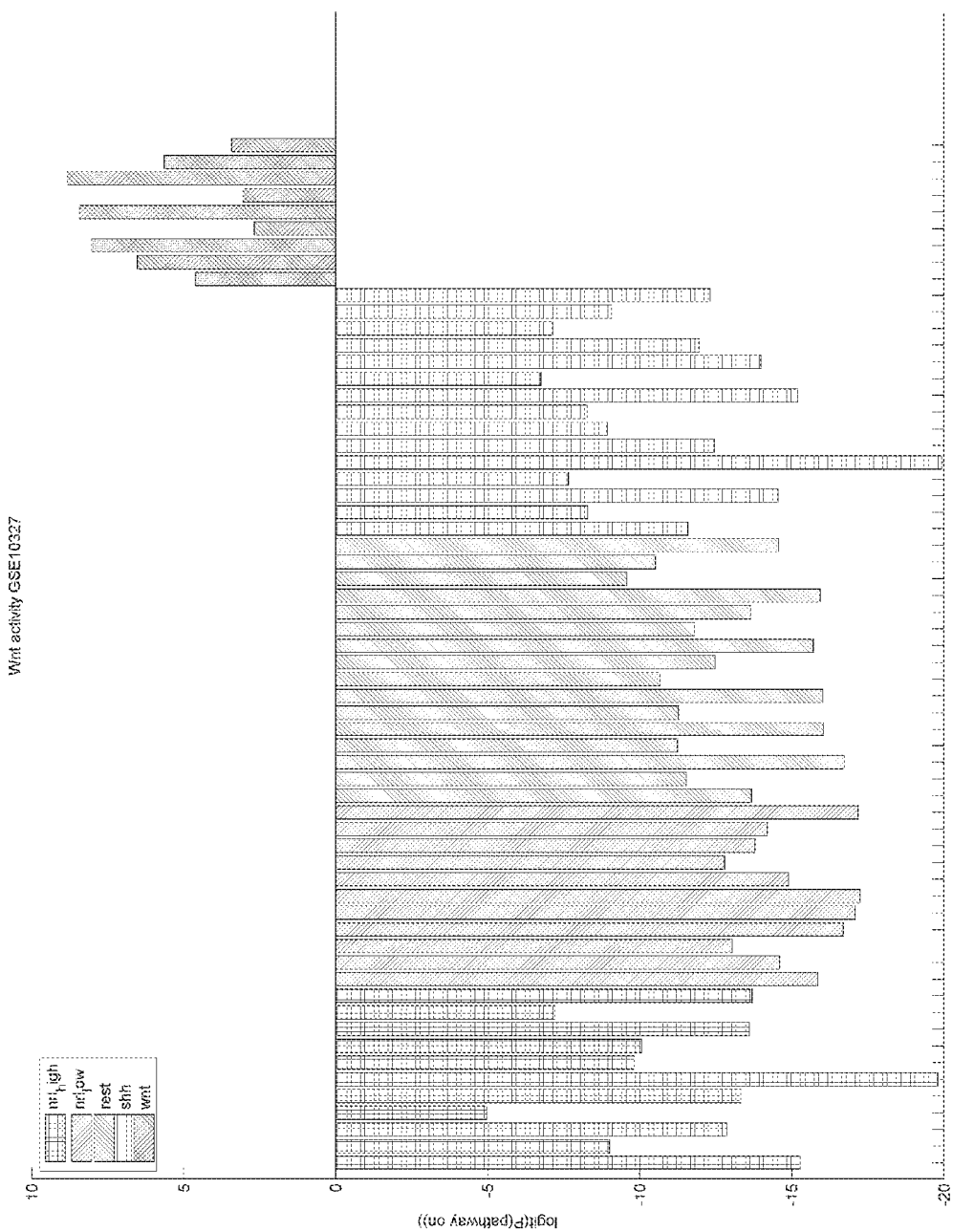
FIG. 19 shows a predicted Wnt pathway activity using a Bayesian network using the target genes of the evidence curated list compared to the target genes of the broad literature list as described herein in a data set of medulloblastoma samples (GSE10327).
Figure 19:
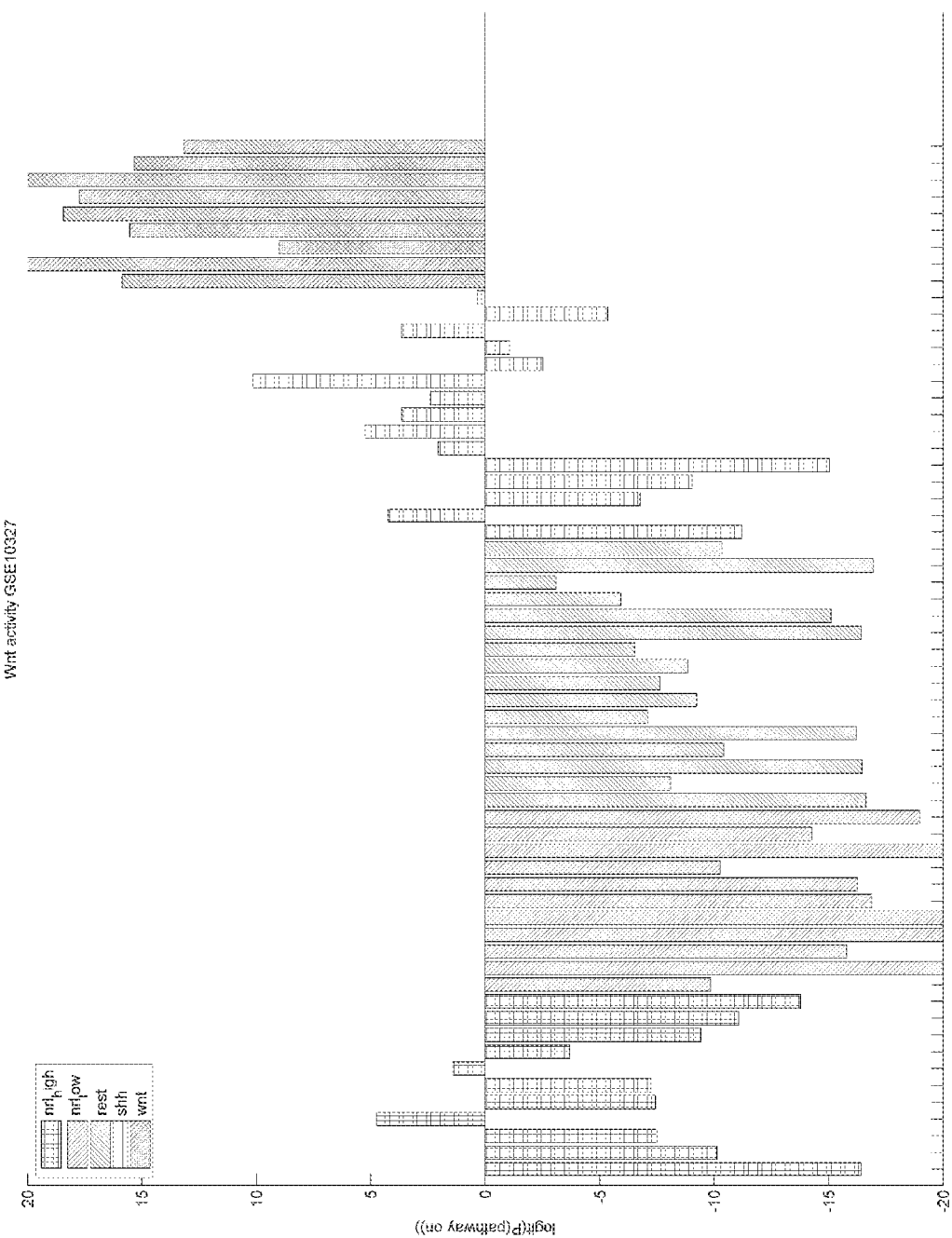

The probabilistic model may optionally also incorporate additional genomic information, such as information on mutations, copy number variations, gene expression, methylation, translocation information, or so forth, which change genomic sequences which are related to the signaling cascade of the pathway to infer the pathway activity and to locate the defect in the Wnt pathway which causes the aberrant functioning (either activation or inactivity), as described by illustrative reference to FIG. 7 for the illustrative case of methylation and copy number data. However, it is to be understood that other types of information regarding the target gene are analogously translated into information nodes. Such genomic information can be available through, but not limited to, RNA sequencing and SNP analysis.

Moreover, it is to be understood that while examples as described later herein pertain to the Wnt, ER, AR and Hedgehog pathway are provided as illustrative examples, the approaches for cellular signaling pathway analysis disclosed herein are readily applied to other cellular signaling pathways besides these pathways, such as to intracellular signaling pathways with receptors in the cell membrane (e.g., the Notch, HER2/PI3K, TGFbeta, EGF, VEGF, and TNF-NFkappaB cellular signaling pathways) and intracellular signaling pathways with receptors inside the cell (e.g., progesterone, retinoic acid, and vitamin D cellular signaling pathways).

Example 2: Comparison of Machine Learning Methods

Here the performance of two types of machine learning techniques are compared to each other with the Wnt pathway taken as an example case: the prediction of Wnt activity by means of a nearest centroid method is compared to the method of choice according to the present invention, which e.g. uses a Bayesian network.

As discussed above the Bayesian network approach was selected based on its advantages residing in the probabilistic approach being able to incorporate the available information in either "soft", e.g. percentages of study subjects exhibiting probative characteristics, and "hard" form, using conditional probabilistic relationships. In addition, the probabilistic model also enables information to be incorporated based on partial (rather than comprehensive) knowledge of the underlying cellular signaling pathway, again through the use of conditional probability tables.

Here it is demonstrated that the inventors added value in the way they included known biological properties and the availability of soft evidence using a Bayesian network compared to other machine learning methods, e.g. nearest centroid classification, a well-known method. Nearest centroid classification is a machine learning method where for each class of training samples an average profile (=centroid) is computed, and next, for a sample to be classified, the label is predicted based on the centroid that is closest (the closest centroid's label is then the prediction result). The two centroids are calculated on the same list of probesets used in the Bayesian network, and for the 'Wnt on' and 'Wnt off' centroid they are based on the adenoma samples and the normal colon samples, respectively, of the same fRMA processed data of GSE8671. The log 2-ratio of the two Euclidean distances between a sample and the two centroids was subsequently used to classify samples from various data sets to infer the classification of the samples. This means that a log 2-ratio of 0 corresponds to an equal distance of the sample to the two centroids, a value >0 corresponds to a sample classified as active Wnt signaling whereas a value <0 corresponds to a sample identified as having an inactive Wnt signaling pathway.

Figure 6:
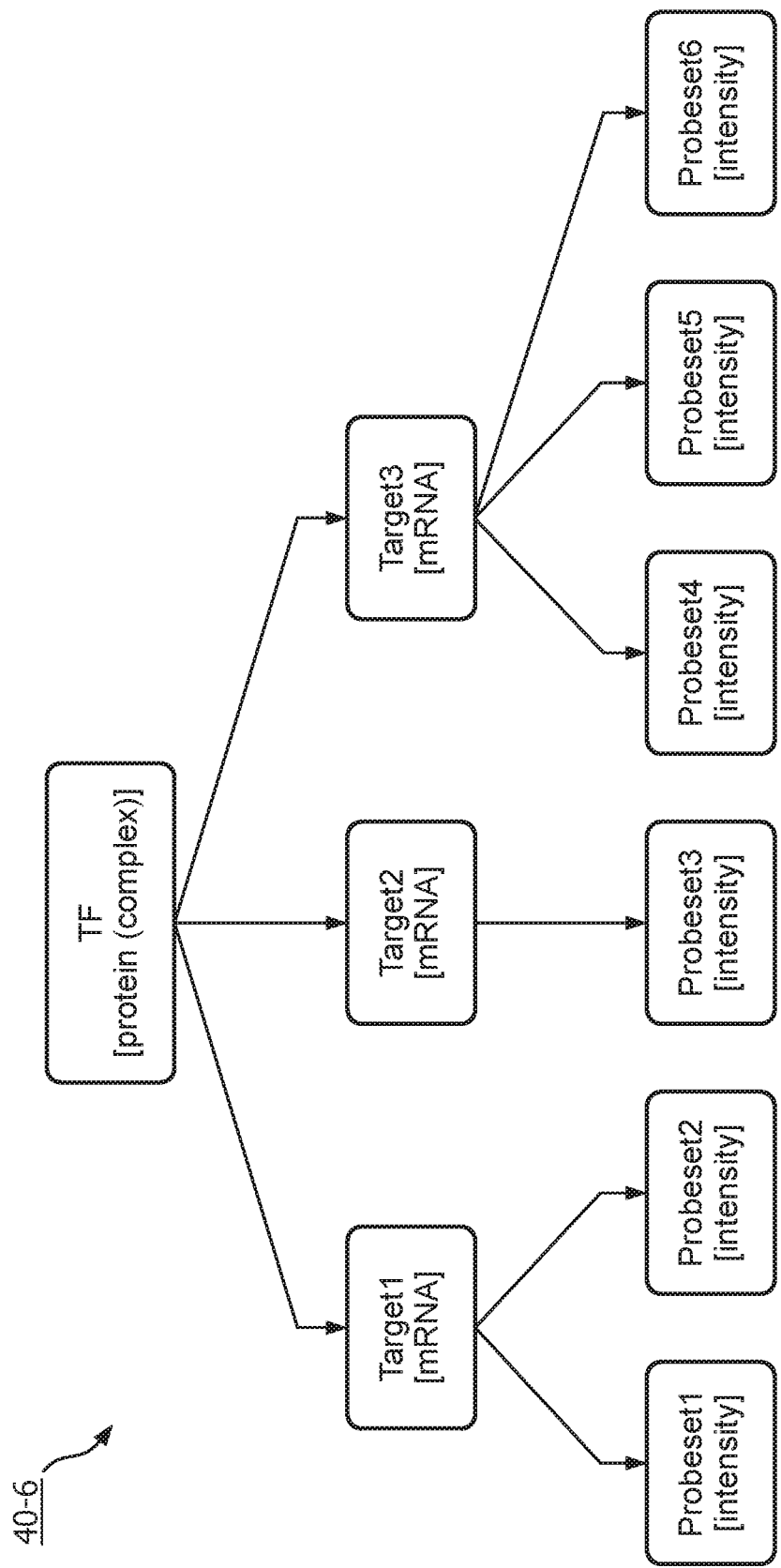
FIG. 6 shows the illustrative Bayesian network of FIG. 1 with an additional layer of nodes representing the probesets on a microarray chip connecting the probes' intensities to the corresponding target mRNA levels.

The Bayesian network was constructed similar to FIG. 6 and the procedure described herein. Similarly to this description of the Wnt Bayesian network, the conditional probability tables of the edges between probesets and their respective genes were trained using fRMA processed data of 32 normal colon samples and 32 adenoma samples from data set GSE8671 from the Gene Expression Omnibus (accessible at ncbi.nlm.nih.gov/geo/, last accessed Jul. 13, 2011). The trained Bayesian network was then tested on various data sets to infer the probability P(Wnt On) that the Wnt pathway is "on", that is, active, which is taken equal to the inferred probability that the Wnt pathway transcription complex is "present".

The trained Bayesian network and nearest centroid model were then tested on various fRMA processed microarray data sets to infer the probability that the Wnt pathway is "on", measured by P(Wnt On) and log 2-ratio of the distances. Summaries of the results of the Bayesian network and the nearest centroid model are shown in FIGS. 8 to 13. The reader should note that the output metrics of the two methods are not a one-to-one relation, however the sign and the relative magnitude of the output metrics within a method are comparable.

The vast majority of the colon (cancer) samples (GSE20916, GSE4183) are classified equally between the active and inactive Wnt pathway, except for GSE15960 that had a high fraction of wrongfully classified negative samples in the nearest centroid method (false negatives). This perception of a higher fraction of false negatives is maintained in the other cancer types as well. This is especially true for breast cancer samples (GSE12777, GSE21653) and liver cancer (GSE9843); except for a few exceptions all samples are predicted to have an inactive Wnt pathway which is known to be incorrect in case of basal-type breast cancer and the CTNNB1 liver cancer samples. In some cases, evident in for example GSE15960, the classification could be corrected by lowering and increasing the threshold of the nearest centroid classification. The idea behind this would be that the threshold of Wnt activity might be altered in different tissue-types. However, this would involve additional training of the nearest centroid method to be applicable to other tissue types. One of the strengths of the Bayesian network model is that this tissue-specific training is not required as it is established to be nonspecific regarding tissue-type.

Example 3: Selection of Target Genes

A transcription factor (TF) is a protein complex (that is, a combination of proteins bound together in a specific structure) or a protein that is able to regulate transcription from target genes by binding to specific DNA sequences, thereby controlling the transcription of genetic information from DNA to mRNA. The mRNA directly produced due to this action of the transcription complex is herein referred to as a "direct target gene". Pathway activation may also result in more secondary gene transcription, referred to as "indirect target genes". In the following, Bayesian network models (as exemplary probabilistic models) comprising or consisting of direct target genes, as direct links between pathway activity and mRNA level, are preferred, however the distinction between direct and indirect target genes is not always evident. Here a method to select direct target genes using a scoring function based on available literature data is presented. Nonetheless, accidently selection of indirect target genes cannot be ruled out due to limited information and biological variations and uncertainties Specific pathway mRNA target genes were selected from the scientific literature, by using a ranking system in which scientific evidence for a specific target gene was given a rating, depending on the type of scientific experiments in which the evidence was accumulated. While some experimental evidence is merely suggestive of a gene being a target gene, like for example a mRNA increasing on an microarray of an embryo in which it is known that the Hedgehog pathway is active, other evidence can be very strong, like the combination of an identified pathway transcription factor binding site and retrieval of this site in a chromatin immunoprecipitation (ChIP) assay after stimulation of the specific pathway in the cell and increase in mRNA after specific stimulation of the pathway in a cell line.

Several types of experiments to find specific pathway target genes can be identified in the scientific literature:
1. ChIP experiments in which direct binding of a pathway-transcription factor to its binding site on the genome is shown. Example: By using chromatin-immunoprecipitation (ChIP) technology subsequently putative functional TCF4 transcription factor binding sites in the DNA of colon cell lines with and without active Wnt pathway were identified, as a subset of the binding sites recognized purely based on nucleotide sequence. Putative functionality was identified as ChIP-derived evidence that the transcription factor was found to bind to the DNA binding site.
2. Electrophoretic Mobility Shift (EMSA) assays which show in vitro binding of a transcription factor to a fragment of DNA containing the binding sequence. Compared to ChIP-based evidence EMSA-based evidence is less strong, since it cannot be translated to the in vivo situation.
3. Stimulation of the pathway and measuring mRNA profiles on a microarray or using RNA sequencing, using pathway-inducible cell lines and measuring mRNA profiles measured several time points after induction—in the presence of cycloheximide, which inhibits translation to protein, thus the induced mRNAs are assumed to be direct target genes.
4. Similar to 3, but using quantitative PCR to measure the amounts of mRNAs.
5. Identification of transcription factor binding sites in the genome using a bioinformatics approach. Example for the Wnt pathway: Using the known TCF4-beta catenin transcription factor DNA binding sequence, a software program was run on the human genome sequence, and potential binding sites were identified, both in gene promoter regions and in other genomic regions.
6. Similar as 3, only in the absence of cycloheximide.
7. Similar to 4, only in the absence of cycloheximide.
8. mRNA expression profiling of specific tissue or cell samples of which it is known that the pathway is active, however in absence of the proper negative control condition.

In the simplest form one can give every potential target mRNA 1 point for each of these experimental approaches in which the target mRNA was identified.

Alternatively, points can be given incrementally, meaning one technology 1 point, second technology adds a second point, and so on. Using this relatively ranking strategy, one can make a list of most reliable target genes.

Alternatively, ranking in another way can be used to identify the target genes that are most likely to be direct target genes, by giving a higher number of points to the technology that provides most evidence for an in vivo direct target gene, in the list above this would mean 8 points for experimental approach 1), 7 to 2), and going down to one point for experimental approach 8. Such a list may be called "general target gene list".

Despite the biological variations and uncertainties, the inventors assumed that the direct target genes are the most likely to be induced in a tissue-independent manner. A list of these target genes may be called "evidence curated target gene list". These curated target lists have been used to construct computational models that can be applied to samples coming from different tissue sources.

The "general target gene list" probably contains genes that are more tissue specific, and can be potentially used to optimize and increase sensitivity and specificity of the model for application at samples from a specific tissue, like breast cancer samples.

The following will illustrate exemplary how the selection of an evidence curated target gene list specifically was constructed for the ER pathway.

For the purpose of selecting ER target genes used as input for the "model", the following three criteria were used:
1. Gene promoter/enhancer region contains an estrogen response element (ERE) motif: a. The ERE motif should be proven to respond to estrogen, e.g., by means of a transient transfection assay in which the specific ERE motif is linked to a reporter gene, and b. The presence of the ERE motif should be confirmed by, e.g., an enriched motif analysis of the gene promoter/enhancer region.
2. ER (differentially) binds in vivo to the promoter/enhancer region of the gene in question, demonstrated by, e.g., a ChIP/CHIP experiment or a chromatin immunoprecipitation assay: a. ER is proven to bind to the promoter/enhancer region of the gene when the ER pathway is active, and b. (preferably) does not bind (or weakly binds) to the gene promoter/enhancer region of the gene if the ER pathway is not active.
3. The gene is differentially transcribed when the ER pathway is active, demonstrated by, e.g., a. fold enrichment of the mRNA of the gene in question through real time PCR, or microarray experiment, or b. the demonstration that RNA Pol II binds to the promoter region of the gene through an immunoprecipitation assay.

The selection was done by defining as ER target genes the genes for which enough and well documented experimental evidence was gathered proving that all three criteria mentioned above were met. A suitable experiment for collecting evidence of ER differential binding is to compare the results of, e.g., a ChIP/CHIP experiment in a cancer cell line that responds to estrogen (e.g., the MCF-7 cell line), when exposed or not exposed to estrogen. The same holds for collecting evidence of mRNA transcription.

The foregoing discusses the generic approach and a more specific example of the target gene selection procedure that has been employed to select a number of target genes based upon the evidence found using above mentioned approach. The lists of target genes used in the Bayesian network models for exemplary pathways, namely the Wnt, ER, Hedgehog and AR pathways are shown in Table 1, Table 2, Table 3 and Table 4, respectively.

The target genes of the ER pathway used for the Bayesian network model of the ER pathway described herein (shown in Table 2) contain a selection of target genes based on their literature evidence score; only the target genes with the highest evidence scores (preferred target genes according to the invention) were added to this short list. The full list of ER target genes, including also those genes with a lower evidence score, is shown in Table 5.

A further subselection or ranking of the target genes of the Wnt, ER, Hedgehog and AR pathways shown in Table 1, Table 2, Table 3 and Table 4 was performed based on a combination of the literature evidence score and the odds ratios calculated using the trained conditional probability tables linking the probeset nodes to the corresponding target gene nodes. The odds ratio is an assessment of the importance of the target gene in inferring activity of the pathways. In general, it is expected that the expression level of a target gene with a higher odds ratio is likely to be more informative as to the overall activity of the pathway as compared with target genes with lower odds ratios. However, because of the complexity of cellular signaling pathways it is to be understood that more complex interrelationships may exist between the target genes and the pathway activity—for example, considering expression levels of various combinations of target genes with low odds ratios may be more probative than considering target genes with higher odds ratios in isolation. In Wnt, ER, Hedgehog and AR modeling reported herein, it has been found that the target genes shown in Table 6, Table 7, Table 8 and Table 9 are of a higher probative nature for predicting the Wnt, ER, Hedgehog and AR pathway activities as compared with the lower-ranked target genes (thus, the target genes shown in Tables 6 to 9 are particularly preferred according to the present invention). Nonetheless, given the relative ease with which acquisition technology such as microarrays can acquire expression levels for large sets of genes, it is contemplated to utilize some or all of the target genes of Table 6, Table 7, Table 8 and Table 9, and to optionally additionally use one, two, some, or all of the additional target genes of ranks shown in Table 1, Table 2, Table 3 and Table 4, in the Bayesian model as depicted in FIG. 6.

TABLE 1

Evidence curated list of target genes of the Wnt pathway used in the Bayesian network and associated probesets used to measure the mRNA expression level of the target genes (# = sequence number in accompanying sequence listing).

| Target gene | Probeset | # | Target gene | Probeset | # |
| --- | --- | --- | --- | --- | --- |
| ADRA2C | 206128_at | 4 | HNF1A | 210515_at | 102 |
| ASCL2 | 207607_at | 10 | | 216930_at | |
| | 229215_at | | IL8 | 202859_x_at | 110 |
| AXIN2 | 222695_s_at | 13 | | 211506_s_at | |
| | 222696_at | | KIAA1199 | 1554685_a_at | 119 |
| | 224176_s_at | | | 212942_s_at | |
| | 224498_x_at | | KLF6 | 1555832_s_at | 121 |
| BMP7 | 209590_at | 17 | | 208960_s_at | |
| | 209591_s_at | | | 208961_s_at | |
| | 211259_s_at | | | 211610_at | |
| | 211260_at | | | 224606_at | |
| CCND1 | 208711_s_at | 27 | LECT2 | 207409_at | 129 |
| | 208712_at | | LEF1 | 210948_s_at | 130 |
| | 214019_at | | | 221557_s_at | |
| CD44 | 1557905_s_at | 30 | | 221558_s_at | |
| | 1565868_at | | LGR5 | 210393_at | 131 |
| | 204489_s_at | | | 213880_at | |
| | 204490_s_at | | MYC | 202431_s_at | 142 |
| | 209835_x_at | | | 244089_at | |
| | 210916_s_at | | NKD1 | 1553115_at | 150 |
| | 212014_x_at | | | 229481_at | |
| | 212063_at | | | 232203_at | |
| | 216056_at | | OAT | 201599_at | 157 |
| | 217523_at | | PPARG | 208510_s_at | 173 |
| | 229221_at | | REG1B | 205886_at | 184 |
| | 234411_x_at | | RNF43 | 218704_at | 189 |
| | 234418_x_at | | SLC1A2 | 1558009_at | 200 |
| COL18A1 | 209081_s_at | 40 | | 1558010_s_at | |
| | 209082_s_at | | | 208389_s_at | |
| DEFA6 | 207814_at | 52 | | 225491_at | |

TABLE 1-continued

Evidence curated list of target genes of the Wnt pathway used in the Bayesian network and associated probesets used to measure the mRNA expression level of the target genes (# = sequence number in accompanying sequence listing).

| Target gene | Probeset | # | Target gene | Probeset | # |
| --- | --- | --- | --- | --- | --- |
| DKK1 | 204602_at | 54 | SOX9 | 202935_s_at | 209 |
| EPHB2 | 209588_s_at | 67 | | 202936_s_at | |
| | 209589_s_at | | SP5 | 235845_at | 210 |
| | 210651_s_at | | TBX3 | 219682_s_at | 215 |
| | 211165_x_at | | | 222917_s_at | |
| EPHB3 | 1438_at | 68 | | 225544_at | |
| | 204600_at | | | 229576_s_at | |
| FAT1 | 201579_at | 72 | TCF7L2 | 212759_s_at | 219 |
| FZD7 | 203705_s_at | 90 | | 212761_at | |
| | 203706_s_at | | | 212762_s_at | |
| GLUL | 200648_s_at | 95 | | 216035_x_at | |
| | 215001_s_at | | | 216037_x_at | |
| | 217202_s_at | | | 216511_s_at | |
| | 217203_at | | | 236094_at | |
| | 242281_at | | TDGF1 | 206286_s_at | 220 |
| | | | ZNRF3 | 226360_at | 248 |

TABLE 2

Evidence curated list of target genes of the ER pathway used in the Bayesian network and associated probesets used to measure the mRNA expression level of the target genes (# = sequence number in accompanying sequence listing).

| Target gene | Probeset | # | Target gene | Probeset | # |
| --- | --- | --- | --- | --- | --- |
| AP1B1 | 205423_at | 5 | RARA | 1565358_at | 183 |
| ATP5J | 202325_s_at | 12 | | 203749_s_at | |
| COL18A1 | 209081_s_at | 40 | | 203750_s_at | |
| | 209082_s_at | | | 211605_s_at | |
| COX7A2L | 201256_at | 41 | | 216300_x_at | |
| CTSD | 200766_at | 46 | SOD1 | 200642_at | 205 |
| DSCAM | 211484_s_at | 59 | TFF1 | 205009_at | 221 |
| | 237268_at | | TRIM25 | 206911_at | 230 |
| | 240218_at | | | 224806_at | |
| EBAG9 | 204274_at | 61 | XBP1 | 200670_at | 244 |
| | 204278_s_at | | | 242021_at | |
| ESR1 | 205225_at | 70 | GREB1 | 205862_at | 97 |
| | 211233_x_at | | | 210562_at | |
| | 211234_x_at | | | 210855_at | |
| | 211235_s_at | | IGFBP4 | 201508_at | 106 |
| | 211627_x_at | | MYC | 202431_s_at | 142 |
| | 215551_at | | | 244089_at | |
| | 215552_s_at | | SGK3 | 227627_at | 196 |
| | 217163_at | | | 220038_at | |
| | 217190_x_at | | WISP2 | 205792_at | 241 |
| | 207672_at | | ERBB2 | 210930_s_at | 69 |
| HSPB1 | 201841_s_at | 103 | | 216836_s_at | |
| KRT19 | 201650_at | 124 | | 234354_x_at | |
| | 228491_at | | CA12 | 203963_at | 22 |
| NDUFV3 | 226209_at | 148 | | 204508_s_at | |
| | 226616_s_at | | | 204509_at | |
| NRIP1 | 202599_s_at | 154 | | 210735_s_at | |
| | 202600_s_at | | | 214164_x_at | |
| PGR | 208305_at | 162 | | 215867_x_at | |
| | 228554_at | | | 241230_at | |
| PISD | 202392_s_at | 164 | CDH26 | 232306_at | 32 |
| PRDM15 | 230553_at | 174 | | 233391_at | |
| | 230777_s_at | | | 233662_at | |
| | 231931_at | | | 233663_s_at | |
| | 234524_at | | CELSR2 | 204029_at | 36 |
| | 236061_at | | | 36499_at | |
| PTMA | 200772_x_at | 179 | | | |
| | 200773_x_at | | | | |
| | 208549_x_at | | | | |
| | 211921_x_at | | | | |

TABLE 3

Evidence curated list of target genes of the Hedgehog pathway used in the Bayesian network and associated probesets used to measure the mRNA expression level of the target genes (# = sequence number in accompanying sequence listing).

| Target gene | Probeset | # | Target gene | Probeset | # |
|---|---|---|---|---|---|
| GLI1 | 206646_at | 93 | CTSL1 | 202087_s_at | 47 |
| PTCH1 | 1555520_at | 177 | TCEA2 | 203919_at | 216 |
|  | 208522_s_at |  |  | 238173_at |  |
|  | 209815_at |  |  | 241428_x_at |  |
|  | 209816_at |  | MYLK | 1563466_at | 145 |
|  | 238754_at |  |  | 1568770_at |  |
| PTCH2 | 221292_at | 178 |  | 1569956_at |  |
| HHIP | 1556037_s_at | 101 |  | 202555_s_at |  |
|  | 223775_at |  |  | 224823_at |  |
|  | 230135_at |  | FYN | 1559101_at | 88 |
|  | 237466_s_at |  |  | 210105_s_at |  |
| SPP1 | 1568574_x_at | 212 |  | 212486_s_at |  |
|  | 209875_at |  |  | 216033_at |  |
| TSC22D1 | 215111_s_at | 232 | PITRM1 | 205273_s_at | 165 |
|  | 235315_at |  |  | 239378_at |  |
|  | 243133_at |  | CFLAR | 208485_x_at | 37 |
|  | 239123_at |  |  | 209508_at |  |
| CCND2 | 200951_s_at | 28 |  | 209939_x_at |  |
|  | 200952_s_at |  |  | 210563_x_at |  |
|  | 200953_s_at |  |  | 210564_x_at |  |
|  | 231259_at |  |  | 211316_x_at |  |
| H19 | 224646_x_at | 253 |  | 211317_s_at |  |
|  | 224997_x_at |  |  | 211862_x_at |  |
| IGFBP6 | 203851_at | 107 |  | 214486_x_at |  |
| TOM1 | 202807_s_at | 229 |  | 214618_at |  |
| JUP | 201015_s_at | 117 |  | 217654_at |  |
| FOXA2 | 210103_s_at | 82 |  | 235427_at |  |
|  | 214312_at |  |  | 237367_x_at |  |
|  | 40284_at |  |  | 239629_at |  |
| MYCN | 209756_s_at | 144 |  | 224261_at |  |
|  | 209757_s_at |  | IL1R2 | 205403_at | 108 |
|  | 211377_x_at |  |  | 211372_s_at |  |
|  | 234376_at |  | S100A7 | 205916_at | 254 |
|  | 242026_at |  | S100A9 | 203535_at | 255 |
| NKX2_2 | 206915_at | 249 | CCND1 | 208711_s_at | 27 |
| NKX2_8 | 207451_at | 250 |  | 208712_at |  |
| RAB34 | 1555630_a_at | 182 |  | 214019_at |  |
|  | 224710_at |  | JAG2 | 209784_s_at | 115 |
| MIF | 217871_s_at | 134 |  | 32137_at |  |
| GLI3 | 1569342_at | 94 | FOXM1 | 202580_x_at | 85 |
|  | 205201_at |  | FOXF1 | 205935_at | 83 |
|  | 227376_at |  | FOXL1 | 216572_at | 84 |
| FST | 204948_s_at | 87 |  | 243409_at |  |
|  | 207345_at |  |  |  |  |
|  | 226847_at |  |  |  |  |
| BCL2 | 203684_s_at | 14 |  |  |  |
|  | 203685_at |  |  |  |  |
|  | 207004_at |  |  |  |  |
|  | 207005_s_at |  |  |  |  |

TABLE 4

Evidence curated list of target genes of the AR pathway used in the Bayesian network and associated probesets used to measure the mRNA expression level of the target genes (# = sequence number in accompanying sequence listing).

| Target gene | Probeset | # | Target gene | Probeset | # |
|---|---|---|---|---|---|
| ABCC4 | 1554918_a_at | 2 | LCP1 | 208885_at | 128 |
|  | 1555039_a_at |  | LRIG1 | 211596_s_at | 132 |
|  | 203196_at |  |  | 238339_x_at |  |
| APP | 200602_at | 7 | NDRG1 | 200632_s_at | 147 |
|  | 211277_x_at |  | NKX3_1 | 209706_at | 251 |
|  | 214953_s_at |  |  | 211497_x_at |  |
| AR | 211110_s_at | 8 |  | 211498_s_at |  |
|  | 211621_at |  | NTS | 206291_at | 155 |
|  | 226192_at |  | PLAU | 205479_s_at | 167 |
|  | 226197_at |  |  | 211668_s_at |  |
| CDKN1A | 1555186_at | 34 | PMEPA1 | 217875_s_at | 169 |
|  | 202284_s_at |  |  | 222449_at |  |
| CREB3L4 | 226455_at | 42 |  | 222450_at |  |
| DHCR24 | 200862_at | 53 | PPAP2A | 209147_s_at | 171 |
| DRG1 | 202810_at | 58 |  | 210946_at |  |
| EAF2 | 1568672_at | 60 | PRKACB | 202741_at | 175 |
|  | 1568673_s_at |  |  | 202742_at |  |
|  | 219551_at |  |  | 235780_at |  |
| ELL2 | 214446_at | 65 | KLK3 | 204582_s_at | 123 |
|  | 226099_at |  |  | 204583_x_at |  |
|  | 226982_at |  | PTPN1 | 202716_at | 180 |
| FGF8 | 208449_s_at | 75 |  | 217686_at |  |
| FKBP5 | 204560_at | 77 | SGK1 | 201739_at | 195 |
|  | 224840_at |  | TACC2 | 1570025_at | 214 |
|  | 224856_at |  |  | 1570546_a_at |  |
| GUCY1A3 | 221942_at | 99 |  | 202289_s_at |  |
|  | 227235_at |  |  | 211382_s_at |  |
|  | 229530_at |  | TMPRSS2 | 1570433_at | 225 |
|  | 239580_at |  |  | 205102_at |  |
| IGF1 | 209540_at | 105 |  | 211689_s_at |  |
|  | 209541_at |  |  | 226553_at |  |
|  | 209542_x_at |  | UGT2B15 | 207392_x_at | 236 |
|  | 211577_s_at |  |  | 216687_x_at |  |
| KLK2 | 1555545_at | 122 |  |  |  |
|  | 209854_s_at |  |  |  |  |
|  | 209855_s_at |  |  |  |  |
|  | 210339_s_at |  |  |  |  |

TABLE 5

Gene symbols of the ER target genes found to have significant literature evidence (=ER target genes longlist) (# = sequence number in accompanying sequence listing).

| Gene symbol | # | Gene symbol | # | Gene symbol | # | Gene symbol | # |
|---|---|---|---|---|---|---|---|
| AP1B1 | 5 | SOD1 | 205 | MYC | 142 | ENSA | 66 |
| COX7A2L | 41 | TFF1 | 221 | ABCA3 | 1 | KIAA0182 | 118 |
| CTSD | 46 | TRIM25 | 230 | ZNF600 | 247 | BRF1 | 19 |
| DSCAM | 59 | XBP1 | 245 | PDZK1 | 160 | CASP8AP2 | 25 |
| EBAG9 | 61 | GREB1 | 97 | LCN2 | 127 | CCNH | 29 |
| ESR1 | 70 | IGFBP4 | 106 | TGFA | 222 | CSDE1 | 43 |
| HSPB1 | 103 | SGK3 | 196 | CHEK1 | 38 | SRSF1 | 213 |
| KRT19 | 124 | WISP2 | 241 | BRCA1 | 18 | CYP1B1 | 48 |
| NDUFV3 | 148 | ERBB2 | 69 | PKIB | 166 | FOXA1 | 81 |
| NRIP1 | 154 | CA12 | 22 | RET | 188 | TUBA1A | 235 |
| PGR | 162 | CELSR2 | 36 | CALCR | 23 | GAPDH | 91 |

TABLE 5-continued

Gene symbols of the ER target genes found to have significant literature evidence (=ER target genes longlist) (# = sequence number in accompanying sequence listing).

| Gene symbol | # | Gene symbol | # | Gene symbol | # | Gene symbol | # |
|---|---|---|---|---|---|---|---|
| PISD | 164 | CDH26 | 32 | CARD10 | 24 | SFI1 | 194 |
| PRDM15 | 174 | ATP5J | 12 | LRIG1 | 132 | ESR2 | 258 |
| PTMA | 179 | COL18A1 | 40 | MYB | 140 | MYBL2 | 141 |
| RARA | 183 | CCND1 | 27 | RERG | 187 | | |

TABLE 6

Shortlist of Wnt target genes based on literature evidence score and odds ratio (# = sequence number in accompanying sequence listing).

| Target gene | # |
|---|---|
| KIAA1199 | 119 |
| AXIN2 | 13 |
| CD44 | 30 |
| RNF43 | 189 |
| MYC | 142 |
| TBX3 | 215 |
| TDGF1 | 220 |
| SOX9 | 209 |
| ASCL2 | 10 |
| IL8 | 110 |
| SP5 | 210 |
| ZNRF3 | 248 |
| EPHB2 | 67 |
| LGR5 | 131 |
| EPHB3 | 68 |
| KLF6 | 121 |
| CCND1 | 27 |
| DEFA6 | 52 |
| FZD7 | 90 |

TABLE 7

Shortlist of ER target genes based on literature evidence score and odds ratio (# = sequence number in accompanying sequence listing).

| Target gene | # |
|---|---|
| CDH26 | 32 |
| SGK3 | 196 |
| PGR | 162 |
| GREB1 | 97 |
| CA12 | 22 |
| XBP1 | 244 |
| CELSR2 | 36 |
| WISP2 | 241 |
| DSCAM | 59 |
| ERBB2 | 69 |
| CTSD | 46 |
| TFF1 | 221 |
| NRIP1 | 154 |

TABLE 8

Shortlist of Hedgehog target genes based on literature evidence score and odds ratio (# = sequence number in accompanying sequence listing).

| Target gene | # |
|---|---|
| GLI1 | 93 |
| PTCH1 | 177 |
| PTCH2 | 178 |
| IGFBP6 | 107 |
| SPP1 | 212 |
| CCND2 | 28 |
| FST | 87 |

TABLE 8-continued

Shortlist of Hedgehog target genes based on literature evidence score and odds ratio (# = sequence number in accompanying sequence listing).

| Target gene | # |
|---|---|
| FOXL1 | 84 |
| CFLAR | 37 |
| TSC22D1 | 232 |
| RAB34 | 182 |
| S100A9 | 255 |
| S100A7 | 254 |
| MYCN | 144 |
| FOXM1 | 85 |
| GLI3 | 94 |
| TCEA2 | 216 |
| FYN | 88 |
| CTSL1 | 47 |

TABLE 9

Shortlist of AR target genes based on literature evidence score and odds ratio (# = sequence number in accompanying sequence listing).

| Target gene | # |
|---|---|
| KLK2 | 122 |
| PMEPA1 | 169 |
| TMPRSS2 | 225 |
| NKX3_1 | 251 |
| ABCC4 | 2 |
| KLK3 | 123 |
| FKBP5 | 77 |
| ELL2 | 65 |
| UGT2B15 | 236 |
| DHCR24 | 53 |
| PPAP2A | 171 |
| NDRG1 | 147 |
| LRIG1 | 132 |
| CREB3L4 | 42 |
| LCP1 | 128 |
| GUCY1A3 | 99 |
| AR | 8 |
| EAF2 | 60 |

Example 4: Comparison of Evidence Curated List and Broad Literature List

The list of Wnt target genes constructed based on literature evidence following the procedure described herein (Table 1) is compared to another list of target genes not following above mentioned procedure. The alternative list is a compilation of genes indicated by a variety of data from various experimental approaches to be a Wnt target gene published in three public sources by renowned labs, known for their expertise in the area of molecular biology and the Wnt pathway. The alternative list is a combination of the genes mentioned in table S3 from Hatzis et al. (Hatzis P, 2008), the text and table S1A from de Sousa e Melo (de Sousa E Melo F, 2011) and the list of target genes collected and maintained by Roel Nusse, a pioneer in the field of Wnt signaling (Nusse, 2012). The combination of these three sources resulted in a list of 124 genes (=broad literature list, see Table 10). Here the question whether the performance in predicting Wnt activity in clinical samples by the algorithm derived from this alternative list is performing similarly or better compared to the model constructed on the basis of the existing list of genes (=evidence curated list, Table 1) is discussed.

TABLE 10

Alternative list of Wnt target genes (=broad literature list) (# = sequence number in accompanying sequence listing).

| Target gene | Reference | # | Target gene | Reference | # |
|---|---|---|---|---|---|
| ADH6 | de Sousa e Melo et al. | 3 | L1CAM | Nusse | 125 |
| ADRA2C | Hatzis et al. | 4 | LBH | Nusse | 126 |
| APCDD1 | de Sousa e Melo et al. | 6 | LEF1 | Hatzis et al., de Sousa e Melo et al., Nusse | 130 |
| ASB4 | de Sousa e Melo et al. | 9 | LGR5 | de Sousa e Melo et al., Nusse | 131 |
| ASCL2 | Hatzis et al., de Sousa e Melo et al. | 10 | LOC283859 | de Sousa e Melo et al. | 260 |
| ATOH1 | Nusse | 11 | MET | Nusse | 133 |
| AXIN2 | Hatzis et al., de Sousa e Melo et al., Nusse | 13 | MMP2 | Nusse | 135 |
| BIRC5 | Nusse | 15 | MMP26 | Nusse | 136 |
| BMP4 | Nusse | 16 | MMP7 | Nusse | 137 |
| BMP7 | Hatzis et al. | 17 | MMP9 | Nusse | 138 |
| BTRC | Nusse | 20 | MRPS6 | Hatzis et al. | 139 |
| BZRAP1 | de Sousa e Melo et al. | 21 | MYC | Hatzis et al., Nusse | 142 |
| SBSPON | de Sousa e Melo et al. | 259 | MYCBP | Nusse | 143 |
| CCL24 | de Sousa e Melo et al. | 26 | MYCN | Nusse | 144 |
| CCND1 | Nusse | 27 | NANOG | Nusse | 146 |
| CD44 | Nusse | 30 | NKD1 | de Sousa e Melo et al. | 150 |
| CDH1 | Nusse | 31 | NOS2 | Nusse | 151 |
| CDK6 | Hatzis et al. | 33 | NOTUM | de Sousa e Melo et al. | 152 |
| CDKN2A | Nusse | 35 | NRCAM | Nusse | 153 |
| CLDN1 | Nusse | 39 | NUAK2 | Hatzis et al. | 156 |
| COL18A1 | Hatzis et al. | 40 | PDGFB | Hatzis et al. | 159 |
| CTLA4 | Nusse | 44 | PFDN4 | Hatzis et al. | 161 |
| CYP4X1 | de Sousa e Melo et al. | 49 | PLAUR | Nusse | 168 |
| CYR61 | Nusse | 50 | POU5F1 | Nusse | 170 |
| DEFA5 | de Sousa e Melo et al. | 51 | PPARD | Nusse | 172 |
| DEFA6 | de Sousa e Melo et al. | 52 | PROX1 | de Sousa e Melo et al. | 176 |
| DKK1 | de Sousa e Melo et al., Nusse | 54 | PTPN1 | Hatzis et al. | 180 |
| DKK4 | de Sousa e Melo et al. | 55 | PTTG1 | Nusse | 181 |
| DLL1 | Nusse | 56 | REG3A | de Sousa e Melo et al. | 185 |
| DPEP1 | de Sousa e Melo et al. | 57 | REG4 | de Sousa e Melo et al. | 186 |
| EDN1 | Nusse | 62 | RPS27 | Hatzis et al. | 190 |
| EGFR | Nusse | 64 | RUNX2 | Nusse | 191 |
| EPHB2 | Hatzis et al., de Sousa e Melo et al., Nusse | 67 | SALL4 | Nusse | 192 |
| EPHB3 | Hatzis et al., Nusse | 68 | SLC1A1 | de Sousa e Melo et al. | 199 |
| ETS2 | Hatzis et al. | 71 | SLC7A5 | Hatzis et al. | 201 |
| FAT1 | Hatzis et al. | 72 | SNAI1 | Nusse | 202 |
| FGF18 | Nusse | 73 | SNAI2 | Nusse | 203 |
| FGF20 | Nusse | 74 | SNAI3 | Nusse | 204 |
| FGF9 | Nusse | 76 | SIK1 | Hatzis et al. | 261 |
| FLAD1 | Hatzis et al. | 78 | SOX17 | Nusse | 206 |
| AK122582 | Hatzis et al. | 262 | SOX2 | de Sousa e Melo et al. | 207 |
| FN1 | Nusse | 79 | SOX4 | Hatzis et al. | 208 |
| FOSL1 | Nusse | 80 | SOX9 | Nusse | 209 |
| FOXN1 | Nusse | 86 | SP5 | Hatzis et al., de Sousa e Melo et al. | 210 |
| FST | Nusse | 87 | SP8 | Hatzis et al. | 211 |
| FZD2 | de Sousa e Melo et al. | 89 | TCF3 | Nusse | 217 |
| FZD7 | Nusse | 90 | TDGF1 | Hatzis et al. | 220 |
| GAST | Nusse | 92 | TIAM1 | Nusse | 224 |
| GMDS | Hatzis et al. | 96 | TNFRSF19 | Nusse | 227 |
| GREM2 | Nusse | 98 | TNFSF11 | Nusse | 228 |
| HES6 | Hatzis et al. | 100 | TRIM29 | de Sousa e Melo et al. | 231 |
| HNF1A | Nusse | 102 | TSPAN5 | de Sousa e Melo et al. | 233 |
| ID2 | Nusse | 104 | TTC9 | de Sousa e Melo et al. | 234 |
| IL22 | de Sousa e Melo et al. | 109 | VCAN | Nusse | 237 |
| IL8 | Nusse | 110 | VEGFA | Nusse | 238 |
| IRX3 | de Sousa e Melo et al. | 111 | VEGFB | Nusse | 239 |
| IRX5 | de Sousa e Melo et al. | 112 | VEGFC | Nusse | 240 |
| ISL1 | Nusse | 113 | WNT10A | Hatzis et al. | 242 |
| JAG1 | Nusse | 114 | WNT3A | Nusse | 243 |
| JUN | Nusse | 116 | ZBTB7C | de Sousa e Melo et al. | 246 |
| KIAA1199 | de Sousa e Melo et al. | 119 | PATZ1 | Hatzis et al. | 263 |
| KLF4 | Hatzis et al. | 120 | ZNRF3 | Hatzis et al. | 248 |

The next step consisted of finding the probesets of the Affymetrix® GeneChip Human Genome U133 Plus 2.0 array that corresponds with the genes. This process was performed using the Bioconductor plugin in R and manual curation for the probesets relevance based on the UCSC genome browser, thereby removing e.g. probesets on opposite strands or outside gene exon regions. For two of the 124 genes there are no probesets available on this microarray-chip and therefore could not be inserted in the Bayesian network, these are LOC283859 and WNT3A. In total 287 probesets were found to correspond to the remaining 122 genes (Table 11).

TABLE 11

Probesets associated with the Wnt target genes in the broad literature gene list (# = sequence number in accompanying sequence listing).

| Gene symbol | Probeset | # | Gene symbol | Probeset | # | Gene symbol | Probeset | # |
|---|---|---|---|---|---|---|---|---|
| ADH6 | 207544_s_at | 3 | FAT1 | 201579_at | 72 | PFDN4 | 205360_at | 161 |
|  | 214261_s_at |  | FGF18 | 206987_x_at | 73 |  | 205361_s_at |  |
| ADRA2C | 206128_at | 4 |  | 211029_x_at |  |  | 205362_s_at |  |
| APCDD1 | 225016_at | 6 |  | 211485_s_at |  | PLAUR | 210845_s_at | 168 |
| ASB4 | 208481_at | 9 |  | 231382_at |  |  | 211924_s_at |  |
|  | 217228_s_at |  | FGF20 | 220394_at | 74 |  | 214866_at |  |
|  | 217229_at |  | FGF9 | 206404_at | 76 | POU5F1 | 208286_x_at | 170 |
|  | 235619_at |  |  | 239178_at |  | PPARD | 208044_s_at | 172 |
|  | 237720_at |  | FLAD1 | 205661_s_at | 78 |  | 210636_at |  |
|  | 237721_s_at |  |  | 212541_at |  |  | 37152_at |  |
| ASCL2 | 207607_s_at | 10 | AK122582 | 235085_at | 262 |  | 242218_at |  |
|  | 229215_at |  | FN1 | 1558199_at | 79 | PROX1 | 207401_at | 176 |
| ATOH1 | 221336_at | 11 |  | 210495_x_at |  |  | 228656_at |  |
| AXIN2 | 222695_s_at | 13 |  | 211719_x_at |  | PTPN1 | 202716_at | 180 |
|  | 222696_at |  |  | 212464_s_at |  |  | 217686_at |  |
|  | 224176_s_at |  |  | 214701_s_at |  |  | 217689_at |  |
|  | 224498_x_at |  |  | 214702_at |  | PTTG1 | 203554_x_at | 181 |
| BIRC5 | 202094_at | 15 |  | 216442_x_at |  | REG3A | 205815_at | 185 |
|  | 202095_s_at |  | FOSL1 | 204420_at | 80 |  | 234280_at |  |
|  | 210334_x_at |  | FOXN1 | 207683_at | 86 | REG4 | 1554436_a_at | 186 |
| BMP4 | 211518_s_at | 16 | FST | 204948_s_at | 87 |  | 223447_at |  |
| BMP7 | 209590_at | 17 |  | 207345_at |  | RPS27 | 200741_s_at | 190 |
|  | 209591_s_at |  |  | 226847_at |  | RUNX2 | 216994_s_at | 191 |
|  | 211259_s_at |  | FZD2 | 210220_at | 89 |  | 221282_x_at |  |
|  | 211260_at |  |  | 238129_s_at |  |  | 232231_at |  |
| BTRC | 1563620_at | 20 | FZD7 | 203705_s_at | 90 |  | 236858_s_at |  |
|  | 204901_at |  |  | 203706_s_at |  |  | 236859_at |  |
|  | 216091_s_at |  | GAST | 208138_at | 92 | SALL4 | 229661_at | 192 |
|  | 222374_at |  | GMDS | 204875_s_at | 96 | SLC1A1 | 206396_at | 199 |
|  | 224471_s_at |  |  | 214106_s_at |  |  | 213664_at |  |
| BZRAP1 | 205839_s_at | 21 | GREM2 | 220794_at | 98 | SLC7A5 | 201195_s_at | 201 |
| SBSPON | 214725_s_at | 259 |  | 235504_at |  | SNAI1 | 219480_at | 202 |
|  | 235209_at |  |  | 240509_at |  | SNAI2 | 213139_at | 203 |
|  | 235210_s_at |  | HES6 | 226446_at | 100 | SNAI3 | 1560228_at | 204 |
| CCL24 | 221463_at | 26 |  | 228169_s_at |  | SIK1 | 208078_s_at | 261 |
| CCND1 | 208711_s_at | 27 | HNF1A | 210515_at | 102 |  | 232470_at |  |
|  | 208712_at |  |  | 216930_at |  | SOX17 | 219993_at | 206 |
|  | 214019_at |  | ID2 | 201565_s_at | 104 |  | 230943_at |  |
| CD44 | 1557905_s_at | 30 |  | 201566_x_at |  | SOX2 | 213721_at | 207 |
|  | 204489_s_at |  |  | 213931_at |  |  | 213722_at |  |
|  | 204490_s_at |  | IL22 | 221165_s_at | 109 |  | 228038_at |  |
|  | 209835_x_at |  |  | 222974_at |  | SOX4 | 201416_at | 208 |
|  | 210916_s_at |  | IL8 | 202859_x_at | 110 |  | 201417_at |  |
|  | 212014_x_at |  |  | 211506_s_at |  |  | 201418_s_at |  |
|  | 212063_at |  | IRX3 | 229638_at | 111 |  | 213668_s_at |  |
|  | 217523_at |  | IRX5 | 210239_at | 112 | SOX9 | 202935_s_at | 209 |
|  | 229221_at |  | ISL1 | 206104_at | 113 |  | 202936_s_at |  |
| CDH1 | 201130_s_at | 31 | JAG1 | 209097_s_at | 114 | SP5 | 235845_at | 210 |
|  | 201131_s_at |  |  | 209098_s_at |  | SP8 | 237449_at | 211 |
|  | 208834_x_at |  |  | 209099_x_at |  |  | 239743_at |  |
| CDK6 | 207143_at | 33 |  | 216268_s_at |  | TCF3 | 209151_x_at | 217 |
|  | 214160_at |  | JUN | 201464_x_at | 116 |  | 209152_s_at |  |
|  | 224847_at |  |  | 201465_s_at |  |  | 209153_s_at |  |
|  | 224848_at |  |  | 201466_s_at |  |  | 210776_x_at |  |
|  | 224851_at |  | KIAA1199 | 1554685_a_at | 119 |  | 213730_x_at |  |
|  | 231198_at |  |  | 212942_s_at |  |  | 213811_x_at |  |
|  | 235287_at |  | KLF4 | 220266_s_at | 120 |  | 215260_s_at |  |
|  | 243000_at |  |  | 221841_s_at |  |  | 216645_at |  |
| CDKN2A | 207039_at | 35 | L1CAM | 204584_at | 125 | TDGF1 | 206286_s_at | 220 |
|  | 209644_x_at |  |  | 204585_s_at |  | TIAM1 | 206409_at | 224 |
|  | 211156_at |  | LBH | 221011_s_at | 126 |  | 213135_at |  |
| CLDN1 | 218182_s_at | 39 | LEF1 | 210948_s_at | 130 | TNFRSF19 | 223827_at | 227 |
|  | 222549_at |  |  | 221557_s_at |  |  | 224090_s_at |  |
| COL18A1 | 209081_s_at | 40 |  | 221558_s_at |  | TNFSF11 | 210643_at | 228 |
|  | 209082_s_at |  | LGR5 | 210393_at | 131 |  | 211153_s_at |  |

TABLE 11-continued

Probesets associated with the Wnt target genes in the broad literature gene list (# = sequence number in accompanying sequence listing).

| Gene symbol | Probeset | # | Gene symbol | Probeset | # | Gene symbol | Probeset | # |
|---|---|---|---|---|---|---|---|---|
| CTLA4 | 221331_x_at | 44 |  | 213880_at |  | TRIM29 | 202504_at | 231 |
|  | 231794_at |  | MET | 203510_at | 133 |  | 211001_at |  |
|  | 234362_s_at |  |  | 211599_x_at |  |  | 211002_s_at |  |
|  | 236341_at |  |  | 213807_x_at |  | TSPAN5 | 209890_at | 233 |
| CYP4X1 | 227702_at | 49 |  | 213816_s_at |  |  | 213968_at |  |
| CYR61 | 201289_at | 50 | MMP2 | 1566678_at | 135 |  | 225387_at |  |
|  | 210764_s_at |  |  | 201069_at |  |  | 225388_at |  |
| DEFA5 | 207529_at | 51 | MMP26 | 220541_at | 136 | TTC9 | 213172_at | 234 |
| DEFA6 | 207814_at | 52 | MMP7 | 204259_at | 137 |  | 213174_at |  |
| DKK1 | 204602_at | 54 | MMP9 | 203936_s_at | 138 | VCAN | 204619_s_at | 237 |
| DKK4 | 206619_at | 55 | MRPS6 | 224919_at | 139 |  | 204620_s_at |  |
| DLL1 | 224215_s_at | 56 | MYC | 202431_s_at | 142 |  | 711571_s_at |  |
|  | 227938_s_at |  | MYCBP | 203359_s_at | 143 |  | 215646_s_at |  |
| DPEP1 | 205983_at | 57 |  | 203360_s_at |  |  | 221731_x_at |  |
| EDN1 | 218995_s_at | 62 |  | 203361_s_at |  | VEGFA | 210512_s_at | 238 |
|  | 222802_at |  | MYCN | 209756_s_at | 144 |  | 210513_s_at |  |
| EGFR | 1565483_at | 64 |  | 209757_s_at |  |  | 211527_x_at |  |
|  | 1565484_x_at |  |  | 211377_x_at |  |  | 212171_x_at |  |
|  | 201983_at |  |  | 234376_at |  | VEGFB | 203683_s_at | 239 |
|  | 201984_s_at |  | NANOG | 220184_at | 146 | VEGFC | 209946_at | 240 |
|  | 210984_x_at |  | NKD1 | 1553115_at | 150 | WNT10A | 223709_s_at | 242 |
|  | 211550_at |  |  | 229481_at |  |  | 229154_at |  |
|  | 211551_at |  |  | 232203_at |  | ZBTB7C | 217675_at | 246 |
|  | 211607_x_at |  | NOS2 | 210037_s_at | 151 | ZBTB7C | 227782_at | 246 |
| EPHB2 | 209588_at | 67 | NOTUM | 228649_at | 152 | PATZ1 | 209431_s_at | 263 |
|  | 209589_s_at |  | NRCAM | 204105_s_at | 153 |  | 211391_s_at |  |
|  | 210651_s_at |  |  | 216959_x_at |  |  | 210581_x_at |  |
|  | 211165_x_at |  | NUAK2 | 220987_s_at | 156 |  | 209494_s_at |  |
| EPHB3 | 1438_at | 68 | PDGFB | 204200_s_at | 159 | ZNRF3 | 226360_at | 248 |
|  | 204600_at |  |  | 216061_x_at |  |  |  |  |
| ETS2 | 201328_at | 71 |  | 217112_at |  |  |  |  |
|  | 201329_s_at |  |  |  |  |  |  |  |

Subsequently the Bayesian network was constructed similar to FIG. 6 and the procedure explained herein. Similarly to the description of the Wnt Bayesian network based on the evidence curated list, the conditional probability tables of the edges between probesets and their respective genes, both the evidence curated list and the broad literature list, were trained using fRMA processed data of 32 normal colon samples and 32 adenoma samples from data set GSE8671 from the Gene Expression Omnibus (accessible at ncbi.nlm-.nih.gov/geo/, last accessed Jul. 13, 2011).

The trained Bayesian networks were then tested on various data sets to infer the probability P(Wnt On) that the Wnt pathway is "on", i.e., active, which is taken equal to the inferred probability that the Wnt pathway transcription complex is "present". Summarized results of the trained broad literature model and the evidence curated model are shown in FIGS. 14-19.

Evidently, it could be deduced that the broad literature model generally predicts more extreme probabilities for Wnt signaling being on or off. In addition, the alternative model predicts similar results for the colon cancer data sets (GSE20916, GSE4183, GSE15960), but more than expected samples with predicted active Wnt signaling in breast cancer (GSE12777), liver cancer (GSE9843) and medulloblastoma sample (GSE10327) data sets.

In conclusion, the broad literature target genes list results in approximately equally well predictions of Wnt activity in colon cancer on the one hand, but worse predictions (too many false positives) in other cancer types on the other hand. This might be a result of the alternative list of targets genes being too much biased towards colon cells specifically, thus too tissue specific; both de Sousa E Melo et al. and Hatzis et al. main interest was colorectal cancer although non-colon-specific Wnt target genes may be included. In addition, non-Wnt-specific target genes possibly included in these lists may be a source of the worsened predictions of Wnt activity in other cancer types. The alternative list is likely to contain more indirectly regulated target genes, which probably makes it more tissue specific. The original list is tuned towards containing direct target genes, which are most likely to represent genes that are Wnt sensitive in all tissues, thus reducing tissue specificity.

Example 5: Training and Using the Bayesian Network

Before the Bayesian network can be used to infer pathway activity in a test sample, the parameters describing the probabilistic relationships between the network elements have to be determined. Furthermore, in case of discrete states of the input measurements, thresholds have to be set that describe how to do the discretization.

Typically, Bayesian networks are trained using a representative set of training samples, of which preferably all states of all network nodes are known. However, it is impractical to obtain training samples from many different kinds of cancers, of which it is known what the activation status is of the pathway to be modeled. As a result, available training sets consist of a limited number of samples, typically from one type of cancer only. To allow the Bayesian network to generalize well to other types of samples, one therefore has to pay special attention to the way the parameters are determined, which is preferably done as follows in the approach described herein.

For the TF node, the (unconditional) probability of being in state "absent" and "present" is given by the expected occurrence on a large set of samples. Alternatively, one can set them to 0.5, as is done in FIG. 1, in order to have no bias for a positive or negative outcome.

For the target gene nodes, the conditional probabilities are set as in FIG. 1. If the TF element is "absent", it is most likely that the target gene is "down", hence a probability of 0.95 is chosen for this, and a probability of 0.05 for the target gene being "up". The latter (non-zero) probability is to account for the (rare) possibility that the target gene is regulated by other factors or accidentally observed "up" (e.g. because of measurement noise). If the TF element is "present", then with a fair probability of 0.70 the target gene is "up", and with a probability of 0.30 the target gene is "down". The latter values are chosen this way, because there can be several reasons why a target gene is not highly expressed even though the TF element is present, for instance because the gene's promoter region is methylated. In the case that a target gene is not up-regulated by the TF element, but down-regulated, the probabilities are chosen in a similar way, but reflecting the down-regulation upon presence of the TF element.

For the Bayesian network model as given in FIG. 6, where the intensities of the probesets form the input measurements, one finally has to determine the parameters for discretization and for the conditional probability tables relating the probesets' intensities to the mRNA levels of the respective target genes. Both of these are based on training data in the current invention. For the discretization of a probeset's intensity level into states "low" and "high", a suitable threshold is determined that best separates the intensity values in a set of training samples where the pathway is activated ("on" samples) from the intensity values in a set of training samples in which it is not ("off" samples). Finally, the conditional probability tables describing the probabilities of a probeset to have a "low" or "high" intensity depending on the "down" or "up" state of the respective target gene is done by counting the number of "on" and "off" samples with an intensity value of the probeset below and above the respective threshold. This is known in the literature as the frequentist approach. A dummy count is added to each group to prevent entries in the conditional probability tables with a value of zero, to prevent extreme behavior of the Bayesian network.

After the Bayesian network has been trained, it can be applied on a test sample as follows, considering the Bayesian network of FIG. 6, and assuming the microarray measurements relating to the probesets are available. The first step is to discretize the input measurements, by comparing each probeset's intensity in the test sample to the respective threshold as described above. This comparison may be done in a hard way, setting each probeset to either "low" or "high" intensity (called 'hard evidence'), or it can be done in a soft way, assuming some uncertainty (noise) in the measurement, setting for each probeset a probability of being "low" or "high" (called 'soft evidence'). For instance, the soft evidence of a probeset with an intensity just below the threshold may be a probability of 0.8 of being "low" and a probability of 0.2 of being "high", based on a suitable estimate of the noise and the difference to the threshold.

Next, this hard or soft evidence is supplied to a suitable inference engine for Bayesian networks, for instance based on a junction tree algorithm (see (Neapolitan, 2004)). Such an engine can then infer the updated probability of the TF element being "absent" or "present", given the provided evidence. The inferred probability of the TF element being "present" is then interpreted as the estimated probability that the respective pathway is active.

Preferably, the training of the Bayesian network models of the Wnt, ER, Hedgehog and AR pathways is done using public data available on the Gene Expression Omnibus (accessible at ncbi.nlm.nih.gov/geo/, cf. above).

The Wnt Bayesian network was exemplary trained using 32 normal colon samples considered to have an inactive Wnt pathway and 32 confirmed adenoma samples known to have an active Wnt pathway (GSE8671 data set).

The Bayesian network model of the ER pathway was exemplary trained using 4 estrogen-deprived MCF7 samples, known to have an inactive ER pathway, and 4 estrogen-stimulated MCF7 samples, regarded to have an active ER pathway, from the GSE8597 data set also accessible at the Gene expression Omnibus.

The Bayesian network model of the Hedgehog pathway was exemplary trained using 15 basal cell carcinoma samples confirmed to have an active Hedgehog pathway and 4 normal skin cells samples representing samples with an inactive Hedgehog pathway available in the GSE7553 data set.

The Bayesian network model of the AR pathway was exemplary trained using 3 samples with positive AR activity, LNCaP cell lines stimulated with Dihydrotestosterone (DHT), a potent AR pathway activator, and 3 non-stimulated LNCaP cell lines representing the inactive AR pathway case.

With reference to FIG. 35 and FIG. 36, the trained Bayesian network models of the Wnt and ER pathway were used to predict the pathway activities in similar samples (colon samples and MCF7 breast cancer cell line for the Wnt and ER Bayesian network, respectively) not used in the training procedure as described herein (no appropriate data set for the Hedgehog Bayesian network was found). The predicted pathway activities of the vast majority of the samples should be in line with the clinically expected pathway activities for the model to be validated.

FIG. 35 shows the predicted Wnt activities, depicted as the logit of P(Wnt on) on the vertical axis, for the samples, illustrated by the bars on the horizontal axis, of the colon samples grouped by classification, indicated by the bar's color, in the GSE20916 data set. All normal colon samples are rightfully predicted to have an inactive pathway (score <0), based on it being a sample of healthy tissue. All but four samples alleged to have an active pathway are predicted to have an active Wnt pathway.

In FIG. 36 the validation results of the trained ER Bayesian network model is shown for two microarrays measured using a MCF7 breast cancer cell line sample, one stimulated with estrogen (E2) the other one with a negative control (EtOH), originating from the GSE9253 data set. In agreement with the alleged ER activity, the sample stimulated with estrogen is predicted to have an active ER pathway, whereas the negative control predicts an inactive ER pathway.

Further details and examples for using trained Bayesian networks (e.g. of Wnt, ER, AR and Hedgehog pathway) to predict the respective pathway activities are explained in Example 6 below.

The above mentioned training process can be employed to other Bayesian networks of clinical applications. Here it is shown and proven to work for the Bayesian network models constructed using herein disclosed method representing cellular signaling pathways, more specifically the Wnt, ER, AR and Hedgehog pathways.

Example 6: Diagnosis of (Abnormal) Pathway Activity

The following will provide an exemplary illustration of how to use e.g. Bayesian network models to diagnose the activity of a cellular signaling pathway.

The Bayesian networks of the Wnt, ER, Hedgehog and AR pathway, constructed using a node for the transcription factor presence, a layer of nodes representing the target genes' mRNA and a layer of nodes representing the probesets' intensities corresponding to the target genes (Table 1, Table 2, Table 3 and Table 4), analogous to FIG. 6 described herein, and trained as described herein, were used to predict the pathways activity as "on", that is active, or "off", that is inactive, in various, previously not used for training, data sets to infer how well the inference component operates. The predicted pathway activity scores are correlated with clinical knowledge. Result summaries for a selection of the test runs are shown in FIG. 21 et seq.

With reference to FIG. 21 et seq., pathway activity inference results for medical tissue samples using the Bayesian network model described herein are shown.

FIG. 21 shows results for Wnt activity tests on colon samples data set GSE4183. The Bayesian network model yielded high values of P(Wnt On) for the adenoma samples, and low values for normal samples, which corresponds with the (patho)physiology of adenoma and healthy tissue. Healthy tissue has a slow cell proliferation and thus a low Wnt activity relative to adenomatous tissue which has a rapid cell proliferation and thus high Wnt activity. For the IBD samples, the Bayesian network model showed low Wnt pathway activity (P(Wnt On)~0) for all but one sample. Again, this is consistent with the IBD samples not undergoing rapid cell proliferation. For the colorectal cancer cell samples the results were mixed, with high Wnt pathway activity being detected in about one half of these samples, but this can be a result of other pathways assuming the role of tumor driver when benign adenomatous tissue becomes malignant cancerous tissue, or sample analysis problems e.g. the sample containing too much non-tumor tissue, or the mRNA being partly degraded The Bayesian network model used in the experiments reported herein was trained using the colon samples data set GSE8671. However, the Wnt pathway is present (albeit possibly inactive) in other cell types. It was therefore considered possible that the Bayesian network might be applicable to infer abnormally high Wnt pathway activity correlative with other types of cancers. The rationale for this is that, although the Bayesian network model was trained using colon samples, it is based on first principles of the operation of the Wnt pathway present (albeit possibly inactive) in other cell types. FIGS. 22-24 show some results investigating such "cross tissue type" inferences.

FIG. 22 shows results for tests using the Bayesian network model trained using colon samples being applied to infer Wnt pathway activity in medulloblastoma samples (data set GSE10327). The samples included in this data set have been further characterized in several subsets, one of them being samples with the Wnt pathway being active. The Bayesian network of the Wnt pathway predicts the group of Wnt-active samples having an active Wnt pathway, whereas the other samples where predicted correctly to have an inactive Wnt pathway.

The test results using the Wnt Bayesian network model in a data set containing liver cancer samples (GSE9843) is shown in FIG. 23. Here the samples are grouped by the following a priori annotations assigned by the GSE9843 data set: "CTNNB1", "Inflammation", "Polysomy chr7", "Proliferation", and "Unannotated". The samples of the "Inflammation" group are uniformly inferred to not have abnormally high Wnt pathway activity, as expected since the inflammation condition does not entail rapid cell proliferation. Samples labeled "Polysomy chr7" are also uniformly inferred to not have abnormally high Wnt pathway activity. Polysomy of chromosome number 7 means that there are more than two number 7 chromosomes. As there is no reason to expect this polysomy condition to impact the Wnt pathway, it is not unexpected that these samples do not have abnormally high Wnt pathway activity.

About one in five of the samples labeled "Proliferation" have P(Wnt On)>0.5. Proliferation suggests a state of rapid cellular multiplication. Such a state may be associated with abnormally high Wnt pathway activity, but may also be associated with numerous other possible causes of cell proliferation. Accordingly, about one in five of these samples having abnormally high Wnt pathway activity is not an unreasonable result.

About one half of the samples of the "CTNNB1" group are inferred by the Bayesian network to have abnormally high Wnt pathway activity. The CTNNB1 gene encodes the beta-catenin protein, which is a regulatory protein of the Wnt pathway, and activating mutations in this gene cause abnormal Wnt activation. Thus, a correlation between the "CTNNB1" group and high Wnt pathway activity is conform expectation.

FIG. 24 depicts the test results of the Wnt Bayesian network model described herein for a set of breast cancer samples. In this case three groups of breast cancer cell lines are tested: one group for which the Wnt pathway is a priori known to be operating at an abnormally high level (Wnt on-group); one group for which the Wnt pathway is a priori known to not be operating at an abnormally high level (Wnt off-group); and another group for which the Wnt pathway activity is not a priori known (Unknown group); in addition there is also one sample that is suspected to have a low level of Wnt activation (Wnt suspicious), although there is a conflicting report in the literature that it may have an active Wnt pathway (but this is a minority report; more papers report an inactive Wnt pathway). As seen in FIG. 24, the correlation of the inferences provided by the Bayesian network with the a priori knowledge is strong for the Wnt on- and off-groups. Also the rightmost sample of the graph (Wnt suspicious) shows an inference that corresponds to most reports in the literature stating that the Wnt pathway is off. In the case of unknown-group shown in FIG. 24, for which there is no a priori knowledge of the Wnt pathway activity, the Bayesian network infers low activity for the Wnt pathway except for one instance for which P(Wnt On)>0.5; literature shows that this cell line has a high expression of the co-receptor LRP6, which may explain that the Wnt pathway is on.

FIG. 25 shows the results for the same data set of breast cancer cell lines but now tested for ER activity using the ER Bayesian network trained using MCF7 breast cancer cell lines as described herein. The samples a priori known to have an active Wnt pathway were predicted to have an inactive ER pathway, which is not surprising since the Wnt pathway is already driving the rapid cell multiplication. ER positive samples, on the other hand are found amongst the Wnt off-samples and the unknown-samples. In view of FIG. 24, this is not surprising.

The test results of the predictions of the ER Bayesian network trained on breast cancer cell lines for a set of cancer samples (GSE12276) are shown in FIG. 26. The breast cancer samples were subdivided in the well-known classifications: Luminal A (LumA), Luminal B (LumB), Human Epidermal Growth Factor Receptor 2 positive (HER2), and basal breast cancer subtype. Tissue samples in the luminal A and luminal B subtypes are known to express ER. It is also in these subtypes that most samples are predicted to have a high ER pathway activity. On the other hand, the samples that are classified to be of the basal subtype are known to have no or low expression of ER, which nicely correlates with no active ER pathway predicted in the basal group samples. In the HER2 group only three samples have a P(ER on)>0.5, whereas the majority of the samples are predicted to have an inactive ER pathway. This correlates well with the fact that the classification is done on the fact that these samples have an amplified HER2 expression; uncontrolled cell replication is presumably driven via HER2 signaling via other cellular signaling pathways than the ER pathway (see for example the Wnt active breast cancer cell lines in FIG. 24 or Hedgehog active breast cancer samples in FIG. 30).

The ER Bayesian network model constructed and trained as described herein is used to predict the ER pathway activity in a large panel of cell lines of various cancers, the results are shown in FIG. 27. As expected only ER active predicted samples were found in the breast cancer cell lines. All other types of cancer cell lines were predicted to have an inactive ER pathway, which is as expected.

The Bayesian network model constructed and trained for the Hedgehog pathway as described herein is used to predict the activity of the Hedgehog pathway for cell lines of various cancer types in the GSE34211-data set. The Hedgehog activity predictions are shown in FIG. 28. The highest fractions of positive predicted Hedgehog activity are found in the central nervous system (CNS), skin, endometrium, and uterus cancer types, which is in good agreement with literature knowledge regarding Hedgehog-dependent cell proliferation in these cell types.

FIG. 29 shows the predicted Hedgehog activity of the medulloblastoma samples (GSE10327) that was already analyzed using the Wnt Bayesian network model as described herein. The medulloblastoma samples have been characterized in subclasses, with one of them having an active Hedgehog signaling pathway (identifier: SHH). All of the samples in the SHH subtype are predicted to have an active Hedgehog signaling. Further, the medulloblastoma samples in the Wnt-subtype were also predicted to have an active Hedgehog pathway. This is in agreement with clinical evidence showing that often both pathways are active in these tumors. Nevertheless, the Wnt Bayesian network was clearly able to correctly predict Wnt activity only in the Wnt-subtype. Thus the combination of the Wnt and Hedgehog Bayesian network are able to make a correct classification of these two subtypes.

The predicted Hedgehog activity in the GSE12276 breast cancer samples, earlier used to predict the ER activity using the ER Bayesian network model, using the Hedgehog Bayesian network model is shown in FIG. 30. The Hedgehog pathway is predicted to be active in a fraction of the samples of every subtype. This seems odd, but matched to the ER pathway prediction shown in FIG. 26 one can see that Hedgehog activity is only predicted in samples not having an active ER pathway. This is in good agreement with the hypothesis that uncontrolled cell proliferation in (breast) tissue can be driven by different signaling pathways.

In summary, the test results for various cancerous tissue samples and cells presented in FIGS. 21-30 strongly suggest that the Bayesian networks of the Wnt, ER and Hedgehog models trained on tissue/pathway specific samples are applicable to analysis of samples of other types of tissue. This can enable cellular signaling pathway analysis to be applied "cross tissue type". Thus, the CDS system (10) (as described herein) is readily applied to assess pathway activity in a range of tissue types other than the tissue type of the samples used to train the Bayesian network model (40) (see e.g. FIG. 20 which shows diagrammatically a clinical decision support (CDS) system configured to assess one or more cellular signaling pathways as disclosed herein (exemplary shown for Wnt pathway)). In cases where the inference components (40), (44), (46), (48) indicate the tissue under analysis exhibits abnormally high Wnt, ER or Hedgehog pathway activity, but no tissue specific drug is available, a general Wnt, ER or Hedgehog pathway suppression drug, or a malfunction specific drug, may be considered by the physician based on the recommendation (28) or the recommendation (26), respectively, as provided by the CDS system (10).

Although the results of FIGS. 21-30 indicate cross tissue type applicability of the Bayesian network model for the Wnt, ER and Hedgehog pathway, it is expected that for clinical applications the Bayesian network models may optionally be updated or adapted to maximize its applicability to the specific tissue type under analysis (e.g., breast tissue or liver tissue). Such updating or adaptation could, for example, entail adjusting the conditional probabilities based on clinical studies of the tissue type under analysis or enrich the evidence curated target gene list, described herein, with tissue specific target genes of the pathway(s) under investigation. Additionally, nodes might be added or removed to better tune the Bayesian network model to the tissue under analysis. Alternatively, different Bayesian network models may be trained ab initio using different training sets for the different tissue types. Furthermore, the results of FIGS. 21-30 illustrate the ability of the process described herein to develop and train Bayesian network models using evidence curated target gene lists of pathways other than Wnt, ER and Hedgehog to predict and diagnose the pathway's activity.

The test results of the AR Bayesian network model constructed and trained as described herein was exemplary used to predict the AR activity in LNCaP prostate cancer cell lines treated with different treatment regimes (GSE7708) (see FIG. 38). As expected LNCaP cells not stimulated with DHT results in a predicted inactive AR pathway, whereas LNCaP stimulated cells were correctly predicted to have an active AR pathway and LNCaP cells treated with Bicalutamide, an anti-androgen drug, to have an inhibited AR pathway.

The trained Bayesian network of the AR pathway as described herein was also used to predict the probability the AR pathway is active in prostate cancer samples from the GSE17951 data set (results are shown in FIG. 39). The majority of the prostate biopsies and tumors were not unexpectedly predicted to have a higher probability of AR activity compared to the controls samples.

The AR Bayesian network model was also applied to a cross-tissue test, viz. the breast cancer samples included in the GSE12276 data set. Results for this test are shown in FIG. 40. A small fraction of the samples, found in every subgroup, are predicted to have an active pathway, whereas the vast majority of the samples had an inactive AR pathway. Remarkably the highest percentage of samples with an active AR pathway are found in the HER2-subgroup, which is not unexpected as it is known from literature that there is crosstalk between the HER2 and AR pathway and the AR pathway can also be induced by HER2-signaling.

The above mentioned AR Bayesian network model was also used to predict the AR pathway's activity in two sets of cell lines samples of various cancer types (GSE36133 and GSE34211) as depicted in FIG. 41 and FIG. 42. As expected, the majority of the cell lines were found to have an inactive AR pathway. The exceptions to this are the prostate cancer samples with several cancer cell line samples expressing AR pathway activity. In Table 12 is shown that all AR pathway activity predictions of the prostate cancer samples are in agreement with the known AR activity.

TABLE 12

Known and predicted AR activity in prostate cancer cell lines in GSE36133 and GSE34211 data sets.

| Data set | Sample identifier | Prostate cell line | Known to be active? | P (AR on) |
|---|---|---|---|---|
| 36133 | GSM886837 | 22Rv1 | YES | 0.698127 |
| | GSM886988 | DU 145 | NO | 0.001279 |
| | GSM887271 | LNCaP clone FGC | YES | 1 |
| | GSM887302 | MDA PCa 2b | YES | 1 |
| | GSM887440 | NCI-H660 | NO | 1.25E−05 |
| | GSM887506 | PC-3 | NO | 0.009829 |
| | GSM887731 | VCaP | YES | 1 |
| 34211 | GSM843494 | DU145T | NO | 0.005278 |
| | GSM844559 | HPET11 | NO | 0.005602 |
| | GSM844560 | HPET13 replicate 1 | NO | 0.003382 |
| | GSM844561 | HPET13 replicate 2 | NO | 0.000501 |
| | GSM844562 | HPET5 | NO | 0.007673 |
| | GSM844579 | LNCAP | YES | 1 |
| | GSM844674 | PC3 PFIZER | NO | 0.004066 |
| | GSM844675 | PC3 Good_NCI50_WYETH | NO | 0.006163 |

Example 7: Prognosis Based on Pathway Activity

Early developmental pathways, like Wnt and Hedgehog, are thought to play a role in metastasis caused by cancer cells which have reverted to a more stem cell like phenotype, called cancer stem cells. Indeed, sufficient evidence is available for the early developmental pathways, such as Wnt pathway, to play a role in cancer metastasis, enabling metastatic cancer cells to start dividing in the seeding location in another organ or tissue. Metastasis is associated with a bad prognosis, thus activity of early developmental pathways, such as the Wnt and Hedgehog pathway, in cancer cells is expected to be predictive for a bad prognosis. This is supported by the fact that breast cancer patients, from the GSE12276 data set, that were identified having an active ER pathway but not having an active Wnt or Hedgehog pathway using the Bayesian network models described herein had a better prognosis than patients identified having either an active Hedgehog or Wnt pathway or both, as illustrated by the Kaplan-Meier plot in FIG. 37.

Example 8: Therapy Planning, Prediction of Drug Efficacy, Prediction of Adverse Effects and Monitoring of Drug Efficacy The following example illustrates how to use the probabilistic models, in particular Bayesian network models, for therapy planning, prediction of drug efficacy, monitoring of drug efficacy and related activities.

The Bayesian network model of the ER pathway, constructed using a node for the transcription factor presence, a layer of nodes representing the target genes' mRNA levels (Table 2) and a layer of nodes representing the probesets' intensities corresponding to the target genes (Table 2), analogous to FIG. 6 described herein, and trained as described herein, were used to predict the pathway activity. The pathway activity is subsequently demonstrated to be correlated with drug efficacy or monitoring drug efficacy. Result summaries are shown in FIGS. 31 and 32.

Tamoxifen is a drug currently used for the treatment of ER+ (estrogen receptor positive) breast cancer. It acts as a partial antagonist of the estrogen receptor inhibiting the uncontrolled cell proliferation which is thought to be induced by ER signaling. Unfortunately, not every breast cancer responds to treatment with Tamoxifen, despite the demonstration of the presence of ER protein in cancer cells by routine histopathology analysis of cancer tissue slides. Many studies have been conducted to investigate this so-called Tamoxifen resistance. The publicly available GSE21618 data set is the result of one of such study and contains microarray data of Tamoxifen resistant and wild-type MCF7 cell lines under different treatment regimes. The ER Bayesian network model constructed and trained as described herein is used to analyze the Tamoxifen resistant and MCF7 cell lines under different treatment regimes, the results are depicted in FIG. 31.

The control Tamoxifen resistant cell line, indicated by TamR.Ctrl, is predicted to have an inactive ER pathway for every time point after Tamoxifen addition (1, 2, 3, 6, 12, 24, and 48 h). It is not surprising that treatment of the Tamoxifen resistant cell line, that is insensitive to Tamoxifen treatment, with Tamoxifen, indicated by TamR.Tam, is ineffective, which is also illustrated by the predicted inactivity of the ER pathway for this group over the same time points. According to analysis of the Tamoxifen resistant cell line (TamR.Ctrl) the driving force of the uncontrolled cell proliferation is not due to active ER signaling; therefore treating it with an ER antagonist will not inhibit cell proliferation. This illustrates that treatment with Tamoxifen is not recommended in case of a negative predicted ER pathway activity.

On the other hand, the wild type MCF7 cell line, known to be Tamoxifen sensitive, treated with 17beta-estradiol (wt1.E2) slowly reacts to the hormone treatment which is visible in the increasing ER positive activity predictions. Treating such a cell line with aromatase inhibitors that are known to inhibit estrogen production will inhibit the ER pathway which is illustrated by the decreasing ER pathway prediction in time. Supporting this are the ER pathway predictions made based on the microarray data from MCF7 samples treated with estrogen for increasing time in the GSE11324 data set, results shown in FIG. 32.

The above mentioned illustrates the ability of the probabilistic models, in particular the Bayesian network models, to be used for therapy planning, drug efficacy prediction, and monitoring of drug efficacy. However it is to be understood, the same methodology would also apply to the prediction and monitoring of adverse effects.

Example 9: Drug Development

In a manner similar to therapy response monitoring, a pathway model can be used in drug development to assess the effectiveness of various putative compounds. For instance, when screening many compounds for a possible effect on a certain pathway in a cancer cell line, the respective pathway model can be used to determine whether the activity of the pathway goes up or down after application of the compound or not. Often, this check is done using only one or a few of putative markers of the pathway's activity, which increases the chance of ineffective monitoring of the treatment effect. Furthermore, in follow-up studies on animal or patient subjects, the pathway models can be used similarly to assess the effectiveness of candidate drugs, and to determine an optimal dose to maximally impact pathway activity.

An example of ineffective monitoring of new drug compounds is illustrated by the predicted AR pathway activity in the GSE7708 samples as shown in FIG. 38. In this study two possible drug compounds to inhibit AR pathway activity, denoted by Polyamide 1 and Polyamide 2, have been developed. It has been demonstrated that these two polyamides are capable of inhibition of the AR pathway based on the findings that polyamides bind to the Androgen Response Element (ARE) and inhibit expression of KLK3 (=PSA), a well-known marker for AR activity also included in the target gene selection as described herein, as well as 35% of the transcripts that were induced by DHT. In contrast the Bayesian network model of the AR pathway predicted these samples to still have an active AR pathway. Investigating the inferred probabilities of the target genes being upregulated using the AR Bayesian network model indicated that KLK3 in contrast to the other target genes was downregulated in accordance to the findings whereas all other target genes (except for AR, GUCY1A3 and TMPRSS2 in case of Polyamide 1) were clearly differentially expressed in the Polyamide 1 and Polyamide 2 treated samples. In other words, only one marker for AR activity, KLK3, was downregulated, whereas the majority of the identified target genes were still upregulated indicating the AR pathway is still largely intact and thus active. By taking into account a larger number of target genes based on literature evidence the inventors were able to show that the inhibition of AR activity of the polyamides is limited and that only KLK3 expression is clearly downregulated using these polyamides. Moreover, this illustrates the value of a systematic approach using a Bayesian network model compared to a reductionist approach in drug development.

Example 10: Assay Development

Instead of applying mentioned Bayesian networks on mRNA input data coming from microarrays or RNA sequencing, it may be beneficial in clinical applications to develop dedicated assays to perform the sample measurements, for instance on an integrated platform using qPCR to determine mRNA levels of target genes. The RNA/DNA sequences of the disclosed target genes can then be used to determine which primers and probes to select on such a platform.

Validation of such a dedicated assay can be done by using the microarray-based Bayesian networks as a reference model, and verifying whether the developed assay gives similar results on a set of validation samples. Next to a dedicated assay, this can also be done to build and calibrate similar Bayesian network models using mRNA-sequencing data as input measurements.

Example 11: Pathway Research and Cancer Pathophysiology Research

The following will illustrate how Bayesian network models can be employed in (clinical) pathway research, that is research interested to find out which pathways are involved in certain diseases, which can be followed up for more detailed research, e.g. to link mutations in signaling proteins to changes in pathway activation (measured with the model). This is relevant to investigate the initiation, growth and evolution and metastasis of specific cancers (the pathophysiology).

The Bayesian network models of the Wnt, ER, Hedgehog and AR pathway, constructed using a node for the transcription factor presence, a layer of nodes representing the target genes' mRNA levels (Table 1, Table 2, Table 3 and Table 4) and a layer of nodes representing the probesets' intensities corresponding to the target genes (Table 1, Table 2, Table 3 and Table 4), analogous to FIG. 6 described herein, and trained as described herein, were used to predict the pathway activity of a data set consisting of breast cancer samples (GSE12276).

Suppose the researcher is interested in looking into the cellular signaling pathway or pathways and the specific deregulation(s) that drive(s) the uncontrolled cell proliferation. The researcher can analyze the microarray data using the above mentioned probabilistic models, in particular the Bayesian network models, to find which pathways are presumably the cause of uncontrolled cell proliferation. Shown in FIG. 33 and FIG. 34 one can see an illustration of such an analysis for the case of Wnt, ER and Hedgehog activity (basal and luminal A samples of the GSE12276 data set). Subsequently, the researcher can search in more detail to find the exact cause of pathway deregulation.

With reference to FIG. 34, the basal samples are known to have triple negative receptor status (ER, PR and HER2), therefore it is not surprising to see that all samples are predicted to have an inactive ER pathway. On the other hand some of the samples are predicted to have either the Wnt or Hedgehog or both active as shown in FIG. 34. These predicted pathway activities persuade the researcher to investigate these samples in more detail for e.g. known mutations or other known deregulations in the Wnt and/or Hedgehog pathways.

Another example is given in FIG. 33, where the Wnt, ER and Hedgehog activities in the luminal A samples of the GSE12276 data set are illustrated. Luminal A samples are known to express ER, however this does not necessarily mean the cancerous properties are due to active ER signaling. From the predicted pathway activities one can infer that less than half of the samples have an active ER signaling. However, some of the samples that do not have an active ER signaling are found to have an active Wnt and/or Hedgehog pathway. This might give rise for the researcher to investigate these samples in closer details for defects in the Wnt and/or Hedgehog signaling pathway, respectively. Some of the samples do not predict any of the included three pathways being active; maybe other pathways are causing the uncontrolled cell proliferations. Also this gives the researcher additional information to search for defects in other pathways.

In summary, the illustrations described herein indicate the ability of trained Bayesian network models (as described above) to support the process of finding the cause of uncontrolled cell proliferation in a more directed method. By employing the Bayesian networks to screen the samples for pathway activities, the predicted pathway activities can pinpoint the possible pathways for the cell proliferation, which can be followed up for more detailed research, e.g. to link mutations in signaling proteins or other known deregulations to changes in activation (as measured with the model).

As described herein, the process to develop and train a Bayesian network of cellular signaling pathways can be used to construct a Bayesian network model for other pathways that could also be employed in connection with the present invention.

Example 12: Enrollment of Subject in a Clinical Trial Based on Predicted Activity If a candidate drug is developed to, for instance, block the activity of a certain pathway that drives tumor growth, and this drug is going into clinical trial, then a proper selection of the subjects to enroll in such a trial is essential to prove potential effectiveness of the drug. In such a case, patients that do not have the respective pathway activated in their tumors should be excluded from the trial, as it is obvious that the drug cannot be effective if the pathway is not activated in the first place. Hence, a pathway model that can predict pathway activity can be used as a selection tool, to only select those patients that are predicted to have the respective pathway activated.

Example 13: Selection of Subsequent Test(s) to be Performed

If a tumor is analyzed using different pathway models, and the models predict deregulation of a certain pathway, then this may guide the selection of subsequent tests to be performed. For instance, one may run a proximity ligation assay (PLA) to confirm the presence of the respective transcription complex (Söderberg O, 2006). Such a PLA can be designed to give a positive result if two key proteins in a TF complex have indeed bound together, for instance beta-catenin and TCF4 in the TF complex of the Wnt pathway.

Another example is that the pathway predicted to be deregulated is analyzed in more detail with respect to the signaling cascade. For instance, one may analyze key proteins in this pathway to determine whether there are mutations in the DNA regions encoding for their respective genes, or one may test for the abundance of these proteins to see whether they are higher or lower than normal. Such tests may indicate what the root cause is behind the deregulation of the pathway, and give insights on which available drugs could be used to reduce activity of the pathway.

These tests are selected to confirm the activity of the pathway as identified using the Bayesian model. However selection of companion diagnostic tests is also possible. After identification of the pathway using the model, for targeted therapy choice only those companion diagnostics tests need to be performed (the selection), which are applicable to the identified pathway.

Example 14: Selection of Companion Diagnostics Tests

Similar to the previous example, if a tumor is analyzed and the pathway models predict deregulation of a certain pathway, and optionally a number of additional tests have been performed to investigate the cause of deregulation, then an oncologist may select a number of candidate drugs to treat the patient. However, treatment with such a drug may require a companion diagnostic test to be executed first, for instance to comply with clinical guidelines or to ensure reimbursement of the treatment costs, or because a regulatory agency (FDA) requires that the companion diagnostic test be performed prior to giving the drug. An example of such a companion diagnostic test is the Her2 test for treatment of breast cancer patients with the drug Herceptin (Trastuzumab). Hence, the outcome of the pathway models can be used to select the candidate drugs and the respective companion diagnostic tests to be performed.

Example 15: CDS Application

With reference to FIG. 20 (diagrammatically showing a clinical decision support (CDS) system configured to assess one or more cellular signaling pathways as disclosed herein (exemplary shown for Wnt pathway)), a clinical decision support (CDS) system (10) is implemented as a suitably configured computer (12). The computer (12) may be configured to operate as the CDS system (10) by executing suitable software, firmware, or other instructions stored on a non-transitory storage medium (not shown) such as a hard drive or other magnetic storage medium, an optical disk or other optical storage medium, a random access memory (RAM), read-only memory (ROM), flash memory, or other electronic storage medium, a network server, or so forth. While the illustrative CDS system (10) is embodied by the illustrative computer (12), more generally the CDS system may be embodied by a digital processing device or an apparatus comprising a digital processor configured to perform clinical decision support methods as set forth herein. For example, the digital processing device may be a handheld device (e.g., a personal data assistant or smartphone running a CDS application), a notebook computer, a desktop computer, a tablet computer or device, a remote network server, or so forth. The computer (12) or other digital processing device typically includes or is operatively connected with a display device (14) via which information including clinical decision support recommendations are displayed to medical personnel. The computer (12) or other digital processing device typically also includes or is operatively connected with one or more user input devices, such as an illustrative keyboard (16), or a mouse, trackball, trackpad, touch-sensitive screen (possibly integrated with the display device (14)), or other pointer-based user input device, via which medical personnel can input information such as operational commands for controlling the CDS system 10, data for use by the CDS system (10), or so forth.

The CDS system (10) receives as input information pertaining to a medical subject (e.g., a hospital patient, or an outpatient being treated by an oncologist, physician, or other medical personnel, or a person undergoing cancer screening or some other medical diagnosis who is known or suspected to have a certain type of cancer such as colon cancer, breast cancer, or liver cancer, or so forth). The CDS system (10) applies various data analysis algorithms to this input information in order to generate clinical decision support recommendations that are presented to medical personnel via the display device (14) (or via a voice synthesizer or other device providing human-perceptible output). In some embodiments, these algorithms may include applying a clinical guideline to the patient. A clinical guideline is a stored set of standard or "canonical" treatment recommendations, typically constructed based on recommendations of a panel of medical experts and optionally formatted in the form of a clinical "flowchart" to facilitate navigating through the clinical guideline. In various embodiments the data processing algorithms of the CDS (10) may additionally or alternatively include various diagnostic or clinical test algorithms that are performed on input information to extract clinical decision recommendations, such as machine learning methods disclosed herein.

In the illustrative CDS systems disclosed herein (e.g., CDS system (10)), the CDS data analysis algorithms include one or more diagnostic or clinical test algorithms that are performed on input genomic and/or proteomic information acquired by one or more medical laboratories (18). These laboratories may be variously located "on-site", that is, at the hospital or other location where the medical subject is undergoing medical examination and/or treatment, or "off-site", e.g. a specialized and centralized laboratory that receives (via mail or another delivery service) a sample of tissue of the medical subject that has been extracted from the medical subject (e.g., a sample obtained from a breast lesion, or from a colon of a medical subject known or suspected of having colon cancer, or from a liver of a medical subject known or suspected of having liver cancer, or so forth, via a biopsy procedure or other sample extraction procedure). The tissue of which a sample is extracted may also be metastatic tissue, e.g. (suspected) malignant tissue originating from the colon, breast, liver, or other organ that has spread outside of the colon, breast, liver, or other organ. In some cases, the tissue sample may be circulating tumor cells, that is, tumor cells that have entered the bloodstream and may be extracted as the extracted tissue sample using suitable isolation techniques. The extracted sample is processed by the laboratory to generate genomic or proteomic information. For example, the extracted sample may be processed using a microarray (also variously referred to in the art as a gene chip, DNA chip, biochip, or so forth) or by quantitative polymerase chain reaction (qPCR) processing to measure probative genomic or proteomic information such as expression levels of genes of interest, for example in the form of a level of messenger ribonucleic acid (mRNA) that is transcribed from the gene, or a level of a protein that is translated from the mRNA transcribed from the gene. As another example, the extracted sample may be processed by a gene sequencing laboratory to generate sequences for deoxyribonucleic acid (DNA), or to generate an RNA sequence, copy number variation, or so forth. Other contemplated measurement approaches include immunohistochemistry (IHC), cytology, fluorescence in situ hybridization (FISH), proximity ligation assay or so forth, performed on a pathology slide. Other information that can be generated by microarray processing, mass spectrometry, gene sequencing, or other laboratory techniques includes methylation information. Various combinations of such genomic and/or proteomic measurements may also be performed.

In some embodiments, the medical laboratories (18) perform a number of standardized data acquisitions on the extracted sample of the tissue of the medical subject, so as to generate a large quantity of genomic and/or proteomic data. For example, the standardized data acquisition techniques may generate an (optionally aligned) DNA sequence for one or more chromosomes or chromosome portions, or for the entire genome of the tissue. Applying a standard microarray can generate thousands or tens of thousands of data items such as expression levels for a large number of genes, various methylation data, and so forth. This plethora of genomic and/or proteomic data, or selected portions thereof, are input to the CDS system (10) to be processed so as to develop clinically useful information for formulating clinical decision support recommendations.

The disclosed CDS systems and related methods relate to processing of genomic and/or proteomic data to assess activity of various cellular signaling pathways. However, it is to be understood that the disclosed CDS systems (e.g., CDS system (10)) may optionally further include diverse additional capabilities, such as generating clinical decision support recommendations in accordance with stored clinical guidelines based on various patient data such as vital sign monitoring data, patient history data, patient demographic data (e.g., gender, age, or so forth), patient medical imaging data, or so forth. Alternatively, in some embodiments the capabilities of the CDS system (10) may be limited to only performing genomic and/or proteomic data analyses to assess cellular signaling pathways as disclosed herein.

With continuing reference to exemplary FIG. 20, the CDS system (10) infers activity of a cellular signaling pathway in the tissue of the medical subject based at least on, but not restricted to, expression levels of target genes of the cellular signaling pathway measured in the extracted sample, and determines whether the cellular signaling pathway is operating abnormally in the tissue of the medical subject based on this inferred activity. Examples disclosed herein relate to the Wnt, ER, AR and Hedgehog pathways as illustrative cellular signaling pathways. These pathways are of interest in various areas of oncology because loss of regulation of the pathways can be a cause of proliferation of a cancer. There are about 10-15 relevant signaling pathways, and each cancer is driven by in principle one dominant pathway being deregulated. Without being limited to any particular theory of operation these pathways regulate cell proliferation, and consequentially a loss of regulation of these pathways in cancer cells can lead to the pathway being "always on" thus accelerating the proliferation of cancer cells, which in turn manifests as a growth, invasion or metastasis (spread) of the cancer.

Measurement of mRNA expression levels of genes that encode for regulatory proteins of the cellular signaling pathway, such as an intermediate protein that is part of a protein cascade forming the cellular signaling pathway, is an indirect measure of the regulatory protein expression level and may or may not correlate strongly with the actual regulatory protein expression level (much less with the overall activity of the cellular signaling pathway). The cellular signaling pathway directly regulates the transcription of the target genes—hence, the expression levels of mRNA transcribed from the target genes is a direct result of this regulatory activity. Hence, the CDS system (10) infers activity of the cellular signaling pathway (e.g., the Wnt, ER, AR and Hedgehog pathways) based at least on expression levels of target genes (mRNA or protein level as a surrogate measurement) of the cellular signaling pathway. This ensures that the CDS system (10) infers the activity of the pathway based on direct information provided by the measured expression levels of the target genes.

However, although, as disclosed herein, being effective for assessing activity of the overall pathways, the measured expression levels (20) of target genes of the pathways are not especially informative as to why the pathways are operating abnormally (if indeed that is the case). Said another way, the measured expression levels (20) of target genes of a pathway can indicate that the pathway is operating abnormally, but do not indicate what portion of the pathway is malfunctioning (e.g., lacks sufficient regulation) in order to cause the overall pathway to operate abnormally.

Accordingly, if the CDS system (10) detects abnormal activity of a particular pathway, the CDS system (10) then optionally makes use of other information provided by the medical laboratories (18) for the extracted sample, such as aligned genetic sequences (22) and/or measured expression level(s) for one or more regulatory genes of the pathway (24), or select the diagnostic test to be performed next in order to assess what portion of the pathway is malfunctioning. To maximize efficiency, in some embodiments this optional assessment of why the pathway is malfunctioning is performed only if the analysis of the measured expression levels (20) of target genes of the pathway indicates that the pathway is operating abnormally. In other embodiments, this assessment is integrated into the probabilistic analysis of the cellular signaling pathway described herein.

In embodiments in which the CDS system (10) assesses what portion of the pathway is malfunctioning, and is successful in doing so, the additional information enables the CDS system (10) to recommend prescribing a drug targeting for the specific malfunction (recommendation (26) shown in FIG. 20). If no specific pathway malfunction is identified (either because the optional additional assessment is not performed or because that assessment fails to identify any particular portion of the pathway that is malfunctioning), then the CDS system (10) can provide a default recommendation (28) recommending the prescription of a general suppression drug for this particular pathway (assuming that the abnormal pathway activity is overly high activity).

Example 16: A Kit and Analysis Tools to Measure Pathway Activity

The set of target genes which are found to best indicate specific pathway activity, based on microarray/RNA sequencing based investigation using the Bayesian model, can be translated into a multiplex quantitative PCR assay to be performed on a tissue or cell sample. To develop such an FDA-approved test for pathway activity, development of a standardized test kit is required, which needs to be clinically validated in clinical trials to obtain regulatory approval.

In general, it is to be understood that while examples pertaining to the Wnt, the ER, the AR and/or the Hedgehog pathway(s) are provided as illustrative examples, the approaches for cellular signaling pathway analysis disclosed herein are readily applied to other cellular signaling pathways besides these pathways, such as to intracellular signaling pathways with receptors in the cell membrane (cf above) and intracellular signaling pathways with receptors inside the cell (cf above). In addition: This application describes several preferred embodiments. Modifications and alterations may occur to others upon reading and understanding the preceding detailed description. It is intended that the application be construed as including all such modifications and alterations insofar as they come within the scope of the appended claims or the equivalents thereof.

Literature de Sousa E Melo F, C. S. (2011). Methylation of cancer-stem-cell-associated Wnt target genes predicts poor prognosis in colorectal cancer patients. Cell Stem Cell, 476-485

Hatzis P, v. d. (2008). Genome-wide pattern of TCF7L2/TCF4 chromatin occupancy in colorectal cancer cells. Mol Cell Biol., 2732-2744

Neapolitan, R. (2004). Learning Bayesian networks. Pearson Prentice Hall

Nusse, R. (2012, May 1). Wnt target genes. Retrieved from The Wnt homepage: stanford.edu/group/nusselab/cgi-bin/wnt/target_genes Söderberg O, G. M. (2006). Direct observation of individual endogenous protein complexes in situ by proximity ligation. Nat Methods, 995-1000 van de Wetering M, S. E.-P.-F. (2002). The beta-catenin/TCF-4 complex imposes a crypt progenitor phenotype on colorectal cancer cells. Cell, 241-250.

SEQUENCE LISTING (251 sequences)

SEQ ID NO: 1 - DNA, 6623 bp, Homo sapiens
  misc feature (1)..(6623): ABCA3
gcggccgctgcgtccgccagtagcgggttgcaggcgcaccctcccctccagggcggccacgcagctgtcagtgccgccgccactgcgaggctggagcggagcccgggtggccgagggaggggaccccgcgagagggccgcgcgccggccgccgccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacagtc

SEQ ID NO: 2 - DNA, 5843 bp, Homo sapiens
  misc feature (1)..(5843): ABCC4
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcaga

SEQ ID NO: 3 - DNA, 1400 bp, Homo sapiens
  misc feature (1)..(1400): ADH6
accagtcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagta

SEQ ID NO: 4 - DNA, 1958 bp, Homo sapiens
  misc feature (1)..(1958): ADRA2C
ccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaa

SEQ ID NO: 5 - DNA, 4194 bp, Homo sapiens
  misc feature (1)..(4194): AP1B1
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaaaaaaaaaaaaaaaaa

SEQ ID NO: 6 - DNA, 2579 bp, Homo sapiens
  misc feature (1)..(2579): APCDD1
gaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctaaaaaaaaaaaaaaaaaa

SEQ ID NO: 7 - DNA, 3648 bp, Homo sapiens
  misc feature (1)..(3648): APP
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 8 - DNA, 10661 bp, Homo sapiens
  misc feature (1)..(10661): AR
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttcaaaaaa

SEQ ID NO: 9 - DNA, 3824 bp, Homo sapiens
  misc feature (1)..(3824): ASB4
cagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagaaatactgggatttttaccactctctctttactgtgtgctgtaactctccaaggactctcatgcacttatcgagatgtgccattagaagaacattacacaacagatgccatagagcaattcctttgctttccctcccattgtcattgaaaaagtacttgcttttagagccagagggaattatttattaagccttatgagacagcagttcccaatcctaggtatttaagtggacttgctgggtagacacagtttgcctaaataaaatggtacttgggttgattataacacttcagggatttcaaaacactttacaaacactgccattaatcctagaatatcatggtatggggaaataaagaagaagtaaagttaaggaattttcaaagacaaggatgtattcagaatgtactgatagaacagtaataactaatatgtatagtgttcttactaagtacctgaaatatttttgtaaaacttcttatatcttatctcatctgaaatgggacccaggttttcttccaaccaatataattctgtgccttatcagtaatatgtttacattctcattcaaatggccatatagcaggctttgcaattggcctcttaaacttggtgttttcccccattaccccttagcagtaattactgtcactagttttgcaaactcctactccccaaaccaagctactcaagtttatttcagtgatgaaggcatatgagcatagtcaaaacaaggagatcttggagtcaaattagaaatgagaaagaaacatcagtccagttaatagtcaagaatggacatttgaaccagacatcactgagccagagactggagatgcaaagatgagtcccatgtgactcctgccttccaggatctcaccatttagcagaggatccagacatacacacagctaactgcaatataaagtgatggggcaagagtacaggtgcagactcacttttaatgcttatctttcaaagttgtgtttctgacatgaagtgtgatttttcttttaagcatgaagttaaagagtgaaggggttatgtaaagtagagggatctcctgctcttgttagggtatttttaaggttttttctagatagtgtgtctttttggtatggtttcttggttagtattaatactttcccagactccttgagaaaaatattgcacactcaatggctccagtgcatgtgacaaggaagcataggaaaatgggggaaagaaagtgtgtgaggggacctagttgattacttcggtctttttatgtagcagactgacatttcatagcattgtagctaagagataaggagcactttgctagtgacagtgggctacgaaaagtaaatagagagactttttgaaaatggtaaaagtttgagaaacttgggaagattagtgtgttaatcaggcttgctagttagtggattgcagaaagaaaaatgtaggtgattaagctctgggccttgtggtttatgaggtcaattttgcttcacttttttttttgttcttgctataatcacttttagataagctcattgctcttagcatcattttttagaggttaaagcagaagtaaattgcaaacaaatctgtcagttgtgagcagatttcttttatgtgtgtggttctccatcatatttaactttggatgctggagtgttgaatagagatgatgtcagatattccaataggctatcatttaatgttaactggcaatcacctaactggttaatctcagttgagactgtgcttctgaactgggattgtcttactcccagggctgtgtaagaaaagtcataggtggatacaataatctcttttaagtatcagttttactcagatattttggtggagatattttgtactaaaacaagatctatatcatggaatagaatgctgaatttgtatgaattattcacataaagcttgatctttcaaaaaatagtttgcttgcagcaagtggtattagaacacatcctaaaacagaatgaaatgatgtcttttgcagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaatcttaaaatagtaataattaacaaagtaaaacaagatcacaccctggaacaattggaggattgcttgctgccctgcatcttaaggcgtattctagcagcaaagcttgtgatgcactgacttggggcaagtaaaactgatgctgaggacaaagggagaagatgttcctcgcccagggaaatgaaaacttttcttattcaccttgcttgtgcttaaacacttatgttcatctagtgtagaatacatggctacttgtttgtaatttttttattggtggaattaaagtaatttttccttatctttgaacttttatttagagaacttaaataaagctcttctgtctccttt

SEQ ID NO: 10 - DNA, 1864 bp, Homo sapiens
  misc feature (1)..(1864): ASCL2
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgacctatgagcctcagccccggaagccgagcgagcggccggcgcgctcatcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaaaaaaaaaaaaaaaa

SEQ ID NO: 11 - DNA, 1065 bp, Homo sapiens
  misc feature (1)..(1065): ATOH1
atgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcccactttgcagggcatctgcacggcacgcgccgcccagtatttgctacattccccggagctgggtgcctcagaggccgctgcgccccgggacgaggtggacggccggggggagctggtaaggaggagcagcggcggtgccagcagcagcaagagccccgggccggtgaaagtgcgggaacagctgtgcaagctgaaaggcggggtggtggtagacgagctgggctgcagccgccaacgggccccttccagcaaacaggtgaatggggtgcagaagcagagacggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttag

SEQ ID NO: 12 - DNA, 1167 bp, Homo sapiens
  misc feature (1)..(1167): ATP5J
tgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgaaaaaaaa

SEQ ID NO: 13 - DNA, 4241 bp, Homo sapiens
  misc feature (1)..(4241): AXIN2
actggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 14 - DNA, 6492 bp, Homo sapiens
  misc feature (1)..(6492): BCL2
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 15 - DNA, 2655 bp, Homo sapiens
  misc feature (1)..(2655): BIRC5
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctaaaaaaaaaaaaaaaaaaaaaaaaa

SEQ ID NO: 16 - DNA, 1957 bp, Homo sapiens
  misc feature (1)..(1957): BMP4
aagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaaaaaaaaaaaaaaaaa

SEQ ID NO: 17 - DNA, 4049 bp, Homo sapiens
  misc feature (1)..(4049): BMP7
agcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggcaaaaaaaaaaaaaaaaaa

SEQ ID NO: 18 - DNA, 7224 bp, Homo sapiens
  misc feature (1)..(7224): BRCA1
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 19 - DNA, 3452 bp, Homo sapiens
  misc feature (1)..(3452): BRF1
aaatgagagacagcgccaaccaggtacccgcgaggacgaccccgccccgcaggacagggcatctccaccgcgcgctggacggaggatacaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggcgcgaccttagcatgccccggtgtgcgaaggctaaaagccagccccacttccctgtgctcgcccagtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaaaaaaaaaaaaaaaaa

SEQ ID NO: 20 - DNA, 6180 bp, Homo sapiens
  misc feature (1)..(6180): BTRC
gattctccttggcccctcagcctgcgcctgagaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaaaaaaaaaaaaaaaaaa

SEQ ID NO: 21 - DNA, 7698 bp, Homo sapiens
  misc feature (1)..(7698): BZRAP1
ctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaatcta

SEQ ID NO: 22 - DNA, 3992 bp, Homo sapiens
  misc feature (1)..(3992): CA12
ataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaaaaaaaaaaaaaaaaaa

SEQ ID NO: 23 - DNA, 3577 bp, Homo sapiens
  misc feature (1)..(3577): CALCR
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 24 - DNA, 3912 bp, Homo sapiens
  misc feature (1)..(3912): CARD10
gccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatagaaaaaaaaaaaaaa

SEQ ID NO: 25 - DNA, 6782 bp, Homo sapiens
  misc feature (1)..(6782): CASP8AP2
aaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgtaaaaaaaaaaa

SEQ ID NO: 26 - DNA, 360 bp, Homo sapiens
  misc feature (1)..(360): CCL24
atggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaa

SEQ ID NO: 27 - DNA, 4304 bp, Homo sapiens
  misc feature (1)..(4304): CCND1
cacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaa

SEQ ID NO: 28 - DNA, 6531 bp, Homo sapiens
  misc feature (1)..(6531): CCND2
gcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattaaaaaaaaaa

SEQ ID NO: 29 - DNA, 1403 bp, Homo sapiens
  misc feature (1)..(1403): CCNH
acttacgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcaaaaaaaaa

SEQ ID NO: 30 - DNA, 5748 bp, Homo sapiens
  misc feature (1)..(5748): CD44
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 31 - DNA, 4815 bp, Homo sapiens
  misc feature (1)..(4815): CDH1
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 32 - DNA, 3193 bp, Homo sapiens
  misc feature (1)..(3193): CDH26
agaccccagccagtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 33 - DNA, 11733 bp, Homo sapiens
  misc feature (1)..(11733): CDK6
cgccgctgtgcccaccccctcgccggagagagtgctggtaactccttccccagagtctgattacctgctccgcgaggccgcggacacgtgcggagagccgactgacactcgcagccccctcgggaggcccgacgcgactgggcccctcaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgatttttctaaccttgaatgctgccagtgtggagtgggtaatccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttggcaaagtatccatcttgtctatctcccggcacttctgaaatatattgctaccattgtataactaataacagattgcttaagctgttcccatgcaccacctgtttgcttgctttcaatgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaatattgcttttcttttaagtgacaatttgactattcttatgataagcacatgagagtgtcttacattttccaaaagcaggctttaattgcatagttgagtctaggaaaaaataatgttaaaagtgaatatgccaccataattacttaattatgttagtatagaaactacagaatatttaccctggaaagaaaatattggaatgttattataaactcttagatatttatataattcaaaagaatgcatgtttcacattgtgacagataaagatgtatgatttctaaggctttaaaaattattcataaaacagtgggcaatagataaaggaaattctggagaaaatgaaggtatttaaagggtagtttcaaagctatatatattttgaaggatatattctttatgaacaaatatattgtaaaaatttatactaaggtcatctggtaactgtgggattaatatggtcgaaaacaaatgttatggagaagctgtcccaagcaaactaaattacctgtacttttttcccatttcaagggaagaggcaaccacatgaagcaatacttcttacacatgcctaagaacgttcattgaaaaaataaatttttaaaaggcatgtgtttcctatgccaccaatacttttgaaaaattgtgaaccttacccaaaaccatttatcatgtccattaagtatatttgggtatataattaggaagatatttacatgttccatctccacagtggaaaaacttattgaggctaccaaagtgtgccaagaaatgtaagtccttagagtaattagaaatgctgttttcctcaaaagcatgagaaactagcattttcatttcttatttactccctttctatatcaatgcaattcacaacccaattttaatacatccctatatctcaagcatttctatcttgtactttttcagaaaataaaccaaaaataatcctttggtctctctatcttctgacctttgtaagcaacagaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagttttttggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactgaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacatgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcacgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcagaaaaaaaaaaaaaaaaaa

SEQ ID NO: 34 - DNA, 2122 bp, Homo sapiens
  misc feature (1)..(2122): CDKN1A
ggtggctattttgtccttgggctgcctgttttcagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaaaaaaaaaaaaaaaaaa

SEQ ID NO: 35 - DNA, 1267 bp, Homo sapiens
  misc feature (1)..(1267): CDKN2A
cgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 36 - DNA, 10540 bp, Homo sapiens
  misc feature (1)..(10540): CELSR2
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggtacagca

SEQ ID NO: 37 - DNA, 10640 bp, Homo sapiens
  misc feature (1)..(10640): CFLAR
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttaaaaaaaaaaaaaaaaaa

SEQ ID NO: 38 - DNA, 3517 bp, Homo sapiens
  misc feature (1)..(3517): CHEK1
cgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaaaaaaaaaaaaaaaaaaaaa

SEQ ID NO: 39 - DNA, 3452 bp, Homo sapiens
  misc feature (1)..(3452): CLDN1
gtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaggatta

SEQ ID NO: 40 - DNA, 5910 bp, Homo sapiens
  misc feature (1)..(5910): COL18A1
agctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 41 - DNA, 1145 bp, Homo sapiens
  misc feature (1)..(1145): COX7A2L
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaaaaaaaaaaaaaaaaaaaaaaaaaaaaaa

SEQ ID NO: 42 - DNA, 1849 bp, Homo sapiens
  misc feature (1)..(1849): CREB3L4
aagagcgccacgcggtgggcgaggggatgccctagtaaattcgcaggtctcttgactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtaaaaaaaaaaaaa

SEQ ID NO: 43 - DNA, 4090 bp, Homo sapiens
  misc feature (1)..(4090): CSDE1
tcactccgccccttctcgtgcacgcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcaaaaaaaaaaaaaaaaaa

SEQ ID NO: 44 - DNA, 2033 bp, Homo sapiens
  misc feature (1)..(2033): CTLA4
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaaaaaaaaaaaaaaaaaaaaaaaaaaaaaaaaaaaaaaaaaaaaaaaaa

SEQ ID NO: 45 - DNA, 3256 bp, Homo sapiens
  misc feature (1)..(3256): CTNNB1
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 46 - DNA, 2141 bp, Homo sapiens
  misc feature (1)..(2141): CTSD
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtaaaaaaaaaaaaaaaaaa

SEQ ID NO: 47 - DNA, 1730 bp, Homo sapiens
  misc feature (1)..(1730): CTSL1
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaa

SEQ ID NO: 48 - DNA, 5160 bp, Homo sapiens
  misc feature (1)..(5160): CYP1B1
aaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtataatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 49 - DNA, 2382 bp, Homo sapiens
  misc feature (1)..(2382): CYP4X1
caaaagcagttgggccgaacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattccttaaaaaaaaaaaaaaaaaaaaaaaaaa

SEQ ID NO: 50 - DNA, 2295 bp, Homo sapiens
  misc feature (1)..(2295): CYR61
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaagaaaa

SEQ ID NO: 51 - DNA, 449 bp, Homo sapiens
  misc feature (1)..(449): DEFA5
atatccactcctgctctccctcctgcaggtgaccccagccatgaggaccatcgccatccttgctgccattctcctggtggccctgcaggcccaggctgagtcactccaggaaagagctgatgaggctacaacccagaagcagtctggggaagacaaccaggaccttgctatctcctttgcaggaaatggactctctgctcttagaacctcaggttctcaggcaagagccacctgctattgccgaaccggccgttgtgctacccgtgagtccctctccggggtgtgtgaaatcagtggccgcctctacagactctgctgtcgctgagcttcctagatagaaaccaaagcagtgcaagattcagttcaaggtcctgaaaaaagaaaaacattttactctgtgtaccttgtgtctttctaaatttctctctccaaaataaagttcaagcatt

SEQ ID NO: 52 - DNA, 479 bp, Homo sapiens
  misc feature (1)..(479): DEFA6
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttaaaaaaaaaaa

SEQ ID NO: 53 - DNA, 4286 bp, Homo sapiens
  misc feature (1)..(4286): DHCR24
aatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccatggctgtggggccgctgcttctgtttaaataaaagtggcctggaagctggc

SEQ ID NO: 54 - DNA, 1815 bp, Homo sapiens
  misc feature (1)..(1815): DKK1
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 55 - DNA, 835 bp, Homo sapiens
  misc feature (1)..(835): DKK4
cagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgcaaaaaaaaaaaaaaaaaa

SEQ ID NO: 56 - DNA, 3366 bp, Homo sapiens
  misc feature (1)..(3366): DLL1
cgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctggggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaaaaaaaaaaaaaaaaaaaaaaaaaaaaaaaaaaaaaaaaaaaaaaaaaaaaaaaaa

SEQ ID NO: 57 - DNA, 1664 bp, Homo sapiens
  misc feature (1)..(1664): DPEP1
ggcacatccacacatgagggaaaaacactgccaggacatctcagggcactctcaggaaatgaggaagctgctggagaagtttctagccttgggggaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaaaaaaaaaaaaaaaaa

SEQ ID NO: 58 - DNA, 1467 bp, Homo sapiens
  misc feature (1)..(1467): DRG1
cctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgcaaaaaaaaaaaaaaaaaa

SEQ ID NO: 59 - DNA, 7110 bp, Homo sapiens
  misc feature (1)..(7110): DSCAM
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatgttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctgttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagagttcctcccaagtttgtggttcagccacgggaccaggacgggatttatggcaaagcagtcatcctcaattgttctgctgagggttaccctgtacctaccatcgtgtggaaattctctaaaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaattcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcagattttgccaactgtgagagaagattctggtttcttttcctgccatgctattaattcttatggggaggaccgtggaataattcagctcacagtgcaagagcccccagaccctcccgaaattgagatcaaagatgtcaaagcacgcacaattacgctcaggtggaccatggggtttgatggaaacagtcccatcacaggctacgatattgaatgcaaaaataaatcagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcagctcctgatggtccacctcaggaagttcacctggagcctatatcatctcagagcatcagggtcacatggaaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatgtgcccagttacccccccgaaaatgtccaagccatagcaacatcaccagaaagcatatcaatatcctggtccacactttccaaggaagccttgaatggaattctccaggggttcagagtcatttactgggccaacctcatggacggagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatgttccaggtcctcccgcgggtgtgaaggcagcggcggcctcagcctccatggtctttgtgtcctggcttccccctctcaagctgaacggcatcatccgaaagtacactgtattctgctcccacccctatcccacagtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaagctcctgcacgaatcctgaccttcagtgggacagtgactactccatggatgaaagacattgtcttgccttgtaaggctgttggggacccttctcctgcagtcaaatggatgaaagacagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaagttccaccagatcagcctcggcttacagtctccaagaccacgtcttcctccatcaccctttcttggctccctggagacaacgggggcagctctatcagaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgagatgcaaagagtttagctgaaatgctcatgagtaagaatacccggacttcagatacgttaagcaagcaacagcagaccctgcgaatgcacatcgacatacccagggctcagcttttgattgaagagagagacacgatggagaccattgatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgaatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgccta

SEQ ID NO: 60 - DNA, 1024 bp, Homo sapiens
  misc feature (1)..(1024): EAF2
gggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttcaaaaa

SEQ ID NO: 61 - DNA, 1655 bp, Homo sapiens
  misc feature (1)..(1655): EBAG9
gacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaaaaaaaaaaaaaaa

SEQ ID NO: 62 - DNA, 2109 bp, Homo sapiens
  misc feature (1)..(2109): EDN1
ggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgaaaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtaaaaaaaaaaaaa

SEQ ID NO: 63 - DNA, 5477 bp, Homo sapiens
  misc feature (1)..(5477): EGF
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagtaaaaaaaaaaaaaaaaaa

SEQ ID NO: 64 - DNA, 5616 bp, Homo sapiens
  misc feature (1)..(5616): EGFR
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 65 - DNA, 6063 bp, Homo sapiens
  misc feature (1)..(6063): ELL2
taagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctgcaggcaccagccgttcagaatctcctgtatgttctagtagagacgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatctgctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaaaaaaaaaaaaaaaaaaa

SEQ ID NO: 66 - DNA, 1300 bp, Homo sapiens
  misc feature (1)..(1300): ENSA
tcgcaacgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaataaaaaaaaaaaaaa

SEQ ID NO: 67 - DNA, 4866 bp, Homo sapiens
  misc feature (1)..(4866): EPHB2
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 68 - DNA, 4234 bp, Homo sapiens
  misc feature (1)..(4234): EPHB3
cgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgaaaaaaaaaaaaaaa

SEQ ID NO: 69 - DNA, 4816 bp, Homo sapiens
  misc feature (1)..(4816): ERBB2
gttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 70 - DNA, 6330 bp, Homo sapiens
  misc feature (1)..(6330): ESR1
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 71 - DNA, 3954 bp, Homo sapiens
  misc feature (1)..(3954): ETS2
agaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggcctcagggccagccggcgagggacccagccgagtgacagcaggaggcggagggaagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaaaaaaaaaaaaaaaaaaaa

SEQ ID NO: 72 - DNA, 14773 bp, Homo sapiens
  misc feature (1)..(14773): FAT1
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttaaaaaaaaaa

SEQ ID NO: 73 - DNA, 1999 bp, Homo sapiens
  misc feature (1)..(1999): FGF18
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaaccaaaaaaaaaaaaaaaaaa

SEQ ID NO: 74 - DNA, 1016 bp, Homo sapiens
  misc feature (1)..(1016): FGF20
agcgacctcagaggagtaaccgggccttaactttttgcgctcgttttgctataatttttctctatccacctccatcccacccccacaacactctttactgggggggtcttttgtgttccggatctccccctccatggctcccttagccgaagtcgggggctttctgggcggcctggagggcttgggccagcaggtgggttcgcatttcctgttgcctcctgccggggagcggccgccgctgctgggcgagcgcaggagcgcggcggagcggagcgcgcgcggcgggccgggggctgcgcagctggcgcacctgcacggcatcctgcgccgccggcagctctattgccgcaccggcttccacctgcagatcctgcccgacggcagcgtgcagggcacccggcaggaccacagcctcttcggtatcttggaattcatcagtgtggcagtgggactggtcagtattagaggtgtggacagtggtctctatcttggaatgaatgacaaaggagaactctatggatcagagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaaggagacgttcaaaatattaaagtctattttctactgagagactggatttggaaagaatattgagaaaaaaaaccaaaaaaaattttgactagaaatagatcatgatcactctttatatgtggattaagttcccttagatacattggattagtccttaccagtagac

SEQ ID NO: 75 - DNA, 949 bp, Homo sapiens
  misc feature (1)..(949): FGF8
acccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgctgcctggccctccccacaatgccagaccgcagagaggctcatcctgtagggcacccaaaactcaagcaagatgagctgtgcgctgctctgcaggctggggaggtgctgggggagccctgggttccggttgttgatattgtttgctgttgggtttttgctgtttttttttttttttttttttttaaaacaaaagag

SEQ ID NO: 76 - DNA, 4545 bp, Homo sapiens
  misc feature (1)..(4545): FGF9
actctgcgcgccggcgggggctgcgcaggaggagcgctccgcccggctacaacgctccgcgagccggcgcggcaacacctgttcgcggcagcctgggcggcacgcgagctcccggacgcggctctcctcgctcgccgctcgccacccgttctaagccaatggacatctgccgagcctctggagaatcctggatactagctttggacgcctaaagtttcttcttctttttgttttattattattatcattttttggaggggggaccgggaggggagatttgtcgccgccaccaacgtgagatttttttttccccttgaaggattcatgctgatgtctgcagagtcggttagagagtaaaaacagcgcatgccttcctggagtcaggatccgtaaattctgacgtagcccgtgcatcttaaaaatccctataataacgcctaggcatttaagttgctatggtcattctgatctcaaaccaaatggagaaactacggattttttttccttattacggtcggatgggatgaagaccttcctgcctgctaagagctggggatctatctatagagatacatagatatgtttatcaatatgtcagtgtgtgagtataaagtggtggtttcttagactatcagtggtttgaccttgaacctgtgccagtgaaacagcagattacttttatttatgcatttaatggattgaagaaaagaaccttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcatcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacagtttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaaggaaaaaaaagtacatagcacagactattttttttaaagacgtaagaatcagattaacaggatcatacttgtaaactttttttggttcacttggctatcaaatatgaaattatagaagtatcataggggtcattgtaacatcttttagagaaaatggctatcagtgtgaactgtcataattacgtggtaatagcacccttagtaaaacttgcaaaatgaaactaataaatcgttatcaataatgacaatgagggggaaagtattatacttgttgactgtgttttgttttttaaaatggtctccacaagcgctcaatttttttagaggggatattactatatagaatatcttttacaaggcttttataacattttatgctgaaaagcataagaatacgtatttctttagtagcaataattttggaacttgcccttgggcaagcgagactatttcttactatatactaaggagaaaagagccaaattcttaaagcaatatttaagaaaaaaggaatttataacaaattctcatctacatatgacactttctagccagttgtgttgagaagtgcaaagtgacggtttaaacatgtgttgggatttattgaactaattttaaaatttactattcaaactttattttgctctgatgcacattctctatgaaaaataaaagtgtgtcactggtgagtgacagctgttatgagctagaagcgcatgacttattgtgacgatgtcttgcctttctgtggtccaagttggagtacatggcaatgccctcctgctgatgtgcattaaggaaaatctaagtctaatatttggaattaagatatattttagggggaggggacagaagcaatgtaaaatagttgatttatgataaagctcagaatgtcctcttcatttattttcttgttttattttcctttctaaacagaaactgcatttaattccaaaaagtagtattcttatttattatttaaccctttgctgctgctaaaatgtgcacatattcaggctttagtttttccaaaaggcattttttttttggctgaaaaatattaaacatttgaccacagggaagaatcaagtttctaggatgtcataggtatactatgtagcactgaaaaaattgattttaggtgacagccaaaagtagtcttaaagtagcatgagaccttagataatcgacctaaaagaaagaaaattgtgaaaaagacaaaaatcttcatgcattcctataaaacgctactttaaggtctacttttggagttaattttgtttggtactttttttttttttaagacgagcaaattgttatatgcttttggcaattgatacaataaactgtaatggtctgtaaataaataaatattgactcatgcgatttatgtaaatagtggaactgggagagtggatggctcagggtttcggtgtgggcattgtctcttgggcagtagagtgagtcatccccagctcatgggtttgcatccagttcttgtcttaagagacccaaagcccagtgaatggcagccctgagccactgtggaatgggggttctggtttcacaaacagatgcttagatagccaaaccactgtcttgttggtgccaacacttgcactgtggtcaaagacttaccgagcatgggctgaacaaccttcccatctgtcatgtgaatgtccccaagcagtggtgaaggacatgctaggtcagtgttggggaacctgccctgccaggtcctgttttgtagataaacaaatggctgccttctggtgtttttattctatttcatctcattaacactacaaccttgtgttatttacttgataatctgtaattgtatgtaaatacatacaggattatgtaatttgtgtaaatacataattacagagttttgaaaactgaaaaaaaaaaaaaaa

SEQ ID NO: 77 - DNA, 3951 bp, Homo sapiens
  misc feature (1)..(3951): FKBP5
agaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttccaaaaaaaaaaa

SEQ ID NO: 78 - DNA, 2260 bp, Homo sapiens
  misc feature (1)..(2260): FLAD1
ttcaatgtcagctaggtgcaaggcgggactttaagtacggaagctgccccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaaaaaaaaaaaaaaaaaaaa

SEQ ID NO: 79 - DNA, 8272 bp, Homo sapiens
  misc feature (1)..(8272): FN1
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 80 - DNA, 1668 bp, Homo sapiens
  misc feature (1)..(1668): FOSL1
acgggccaaggcggcgcgtctcgggggtggagcctggaggtgaccgcgccgctgcaacgcccccaccccccgcggtcgcagtggttcagcccgagaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtg

SEQ ID NO: 81 - DNA, 3396 bp, Homo sapiens
  misc feature (1)..(3396): FOXA1
gggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaagagcatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttgagatttttaagattctttattcccagtgatgtttacttcatttttttttttttttttgacaccggcttaagccttctgtgtttcctttgagccttttcactacaaaatcaaatattaatttaactacctttcctccttccccaatgtatcacttttctttatctgagaattcttccaatgaaaataaaatatcagctgtggctgatagaattaagttgtgtccaaaaaaaaaaaaaaaaaa

SEQ ID NO: 82 - DNA, 2428 bp, Homo sapiens
  misc feature (1)..(2428): FOXA2
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 83 - DNA, 2579 bp, Homo sapiens
  misc feature (1)..(2579): FOXF1
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttaaaaaaaaaaaaaaaaaa

SEQ ID NO: 84 - DNA, 3207 bp, Homo sapiens
  misc feature (1)..(3207): FOXL1
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 85 - DNA, 3551 bp, Homo sapiens
  misc feature (1)..(3551): FOXM1
tttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgaaaaaaaaaaaaaaaaaaa

SEQ ID NO: 86 - DNA, 2697 bp, Homo sapiens
  misc feature (1)..(2697): FOXN1
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaa

SEQ ID NO: 87 - DNA, 1834 bp, Homo sapiens
  misc feature (1)..(1834): FST
ttgggaagggtttccagaaggtgggaaatgtcacctgattcacactgaacttttgaaagctccccacccccaaggagccgcgcacaccctcgctcgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcac

SEQ ID NO: 88 - DNA, 3628 bp, Homo sapiens
  misc feature (1)..(3628): FYN
agagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 89 - DNA, 3834 bp, Homo sapiens
  misc feature (1)..(3834): FZD2
gaggagagagggcagcagcgcgcggtgtctccggctgctcagtccgaccgcggcaagcaagcgggcaggcgcaccgccccctcccccgcccggcctccccaactctgcggccgcgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacacccccacaaggtttgtaattaaaactgtaaatagtctttgtaaatttaattatatatattttctatttaaaagaaaaaaggagaaaaaaaaacaggggtgtgggcgccaggactgaagaatgaggtgtgtgtgtgttggggagtgtagttggggggagggttctctttcttaagtgcccttcaaaacccgccccacttttggagttttttggtgatatggcagggctgggcctgatgggagaggcacccagcctgagcgctgtttttgttggctttgagtcgttaggagtttgttccattcaactaatataaaagccaaatttgtgagcctcctctctgacgctgggcctgtggaagccgttggatatttttgaacaggacttggattcgttttgtttccttcccccttttctttccctactcatttgtcctgtcttcttcactcactcttggaaaagtcccaacagagatgaagacgtggaaaaaaaaatcggggtcggggtgtgctggtggggagagggcagagatccggtgaggaatggcttccaccccctggcccattcccctgcaggctggaagatctttctcctgtctggcttctcttcttttcaattcgctgcaccaagtgcttccagtggcccaaaaatgctttttgaagtgtgttttgaaacagcccccaccaacatacaccccaccaggagtactgatcctgcctcccttcatgtctaggggaagcattcgcctttgagcacttgtttgcaaatctggggagtttgagacctcctagcatctcttcccttctttccctgcagtctattcactcccgcagccaaaaatctctggcgttcaggttagcagtttctgggttggtttgtgtgggtttttgttgttgtttggggcttatttttttcaaaaagtgataaagacgggtgggttggagggaggggactgatgggctggtgggctttttagttttcctttgagaaaaagactggtttatttaaaatttgtccagaaaaaaatgaaaaaaaaaaaaaaggtggtatctttgctttagaagaagtctctggataggccctttgtggctgtgggggtgggttgagtgtttacattacattctatatcacaagattgataggatgtttaaagcagatgtttcttatcttcccctgagcccctacaaataaagtcaagacttttctttttttgagacggagtcttgctctgtcgcccaggctggagtgcagtggtgcgatcttggctcactgcaacctccactgcagcgtttctcctgcctcagcctcccaagtagctgggactacaggcgcacgccaccactccttgctaatttttgtatttttagtagacacagggtttcaccatattggccaggctggtctcgaactcctgacctcgttatctgcctgcctcggcctcctaaagtgctgggattacaggagtgagccacagtgcctggcctgtcaagacttctcttaagttaacttcctgagaagtgatgtctaaaagtatctttgctggtgtgagaactccagtttccaacacatattatttccctcaactatttggaatattttagaattttaattccaaaggattagtttgaatacaagtatgccacataactcagttttcgccatcttccatttcttaacagtgtaaattaaaagctaataatcataataataaagtgcatttaattatctttgaaaaaaaaaaaaaaaa

SEQ ID NO: 90 - DNA, 3851 bp, Homo sapiens
  misc feature (1)..(3851): FZD7
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 91 - DNA, 1401 bp, Homo sapiens
  misc feature (1)..(1401): GAPDH
ggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaa

SEQ ID NO: 92 - DNA, 475 bp, Homo sapiens
  misc feature (1)..(475): GAST
agagcagagacctgagaggcaccaggcccagccgtggcaccacacacctcccagctctgcagacgagatgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccactccagccctgtcccctgaaaaactgatcaaaaataaactagtttccagtggaaaaaa

SEQ ID NO: 93 - DNA, 3618 bp, Homo sapiens
  misc feature (1)..(3618): GLI1
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcagaaaaaaaaaaaaaaaaaa

SEQ ID NO: 94 - DNA, 8228 bp, Homo sapiens
  misc feature (1)..(8228): GLI3
ccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttacatgtgctcagtgttttgttttgtgttttggtttctgttttttattttaattcccacattgggcacaagaatcagaatatggatagctagtttaagaaacttttgtgggtgcactgtagcatagatgacagaatattgatgttccccccatctccaattcagttcagggcattccacagttaaacagaaatgggaacgtggggctcttataaatgaaatgggcgctcacagttttggttttcagctcttcatgtctgtaagtgtgctttgggggaggctatgtctgtatggtcgattctcagttatcacatttgcctctcctcccactaccttcatgaacattcagtgctgtttcgcactgcagttagagagaagggacggacagttggtgacactcagccacattgctacttttatctgttctggtaagaagttagatagatggtagattgaagcaattgggtagaattagttgggggaatatttatgagttgctgtgtttgttgattagttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaaaaaaaaaaaaaaa

SEQ ID NO: 95 - DNA, 4737 bp, Homo sapiens
  misc feature (1)..(4737): GLUL
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctgaaaaaaaaaaaaaaaaaa

SEQ ID NO: 96 - DNA, 1446 bp, Homo sapiens
  misc feature (1)..(1446): GMDS
tgtacacaggcagtttgttgggagcgttaccattgcctctggttcctcatgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagcattcaca

SEQ ID NO: 97 - DNA, 8482 bp, Homo sapiens
  misc feature (1)..(8482): GREB1
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 98 - DNA, 4199 bp, Homo sapiens
  misc feature (1)..(4199): GREM2
aggattcagagctaagtctccgggctcctttcacatctgcaggagcagccagcctgggaccgcgcggcgcggggcgcgctctcgcctctcctgcaccctcagccggcgcgcttctcttatgggcgtctgctgcagtctggctgcggtcgaactgaaagcggcggcgggagaccaaacttagaccccgctgtggactagagaactcagagaaggcagagggagagggagagagagagagagaagggacccgaggaggaggcttccatcacgtcattgcaggatgttctggaagctttccctgtccttgttcctggtggcggtgctggtgaaggtggcggaagcccggaagaaccggccggcgggcgccatcccctcgccttacaaggacggcagcagcaacaactcggagagatggcagcaccagatcaaggaggtgctggcctccagccaggaggccctggtggtcaccgagcgcaagtacctcaagagtgactggtgcaagacgcagccgctgcggcagacggtgagcgaggagggctgccggagccgcaccatcctcaaccgcttctgctacggccagtgcaactccttctacatcccgcggcacgtgaagaaggaggaggagtccttccagtcctgcgccttctgcaagccccagcgcgtcacctccgtcctcgtggagctcgagtgccccggcctggacccacccttccgactcaagaaaatccagaaggtgaagcagtgccggtgcatgtccgtgaacctgagcgactcggacaagcagtgagcgccgggccggacgcagctcagccccgcgcgcgcccggccgctgggtggcgccgccgccgcctctgtccctgccctccgagcccactgtcacgctgcctggtgttccccctcagcagcaagcacttctcttagggctgacggtgtccttgtcacagacgtggatcgcaagtggagcttttgctgatgtgttcctgaccgaccccgggtcccacctgtgccccctaaaccaggcggtggatcaggcccgaaggaaaatgctggaaaaccaccaccgccacccagcagtcagagaggacctttcgaggtgatgcactgtaaatccggcattgatgtttccaccatgtggaaaagcaaggatttccctggccccgccctgcactccagctcgcccctttcccgcgcgaagtgaaggatgcgtcacttttctgagcggcccctcagacctctcctgctggtccctggacctctggctgggagcgctcattcttgtgactggcaggctgccctcggtcgctgctgtgatgaggatatgtgcaacctccataaatatgtcggtggacggggcgtctcctaataaacctgataccaagaagacaacttgagccacttggatcccgaagtgggcttcccgggaaacctcgagcagagcaggctacacaatcccccatcctcaagtccccaccgcctcttcttcctcactgtccccgccccctatttgtggactaaagatgaactctggtgtgcatgctattattgctgcaattagaatattatcacacacaaaggtctctatattaacgctggttttataagtgaccgtatattgtaaagagctgttaaaaagtattatagacctattcatgtattatttcacatgttttgactctggcttgcagcaccattcggagtaaggatgacagcaggcccagaaggtgtcttactcagaaaaaaaaatgcctggtcagcaattcactgtcatgcacctatttttagattgggcagggagatgggaggagtcgtgatttttactttgaatactatttcactgacgttactaagcattgcagcacaatgtagaaattggcttgggatggataggtatagggaagggcattcgttgggaaattgatgaccggaaactagaaagcccctataatgtggaatatgcatatgtggggtgaaaccgtatactactttcactgccatgacactaggcaaaaaatatttcctgttaaaagaaagagaaaaagagagggatattgaaaaatataaggagttgagtcgctttgtggtatagaagggagtaaggaataaaagatatagaatagtaatctagttgaactgttctgcacaaaacatgcttccttttcaaagaatagacttcaaaagggacgaacaaacattaggtcaccttttgtgtttataatgaattgttgacgtttccatgctgtggtctcttgatatacggaagtagacgtaacttattttccagcgaaattatatacttcttctgggctcctttgctcagttgccccaggaaggcttccctgtgagtaatgcttatggaatctgacaaatgtgaatgagctgccattggtgggaatcagtaaactttgaaaacctttcactgatgattccctggtaagtgctcctgtgaggggccacttccctagtatgtgagagagaccctctgcaagccgctgtggggacttagcttcctgatactaggtagtgatggtggatctagagacattcacttgaagagcaaggattggggtggggtgggttggtgaatctatctcaggccactgcactgcaaggtgcatttctgtcatttctgcaacaccatgagacctgagcaagaatgtgctgtggcagagggggtcttggtttcataaatgggtatatacagcctgaactcaggaggcagaaatcaaaagaaatccttgagggctggaacctgaggatagagcgaaaatggagagaagggtgttcaaggtcaggagtgatttttgcatttggtggaaaacctcaagtcagactcagtggcagaacatgcagcagaaaagctgtgaaggaaggaaatttacgtgattgtaatggaggctaggggtggattgggaggtgagtggaggagagtctctgaccagctgcagagccaacccctatcattttattaacatggaacccacacagataggggagggattaagctaagaacttacagaatgcaaacacgagcacactctcttcgaacccaattgtgggtgtagcaatgaaagcaatatgatatgctgcagtgtgaagctccttctggggttatcgtatgtacaaagtttaccttataatggctcaaattgtatttaatttttttgttttgtttataaatgaagaaaagctataagtataatgtaattattttataggtatactattaaattatagaacaaataaagataatctaggattatatgtgatcccggtgtgacgtgccataaaagtggaatttttgacttgttgcagtgagctgtgaagcagcactatgcgttcagagagtttttgttcaaccatggtgagttcaacctctagcttatgtcacatgatctcctttggggtctggaatcttctaagagaaatagaatcaggcatccaaggagcagaagtgatggaggtggccctcaatcctggtctttggaagcttccaagcctcttccacatcccctgccagctgaagacagagtattctcactgtgctggctgaaggagaaacactaaacaaggaaaccttgagaaactgcagcaatggaagtccactgttagtctctccgttagcaccagggacacacttgttctgagttttgttcattttcacatttactcctcatgagttccaacatttcttaatttaaatatttcttagtttatagcatctccatttttctattaattgacttaatctgccatttaagaaaactccgtaatcaataaaaaataaaatccacaatcaaactgcacatggttgatccactgtgtaggcttcaaaggaattaaactcaacttcctaggaaataattcatcttagtttattaaatgggacagaatatttcactgctaacgtattctaactcacttgtttttgaaattggccagatgatttttaagttataaagtcaatgaaaatgacttttgctattgtgtgaacaacttagaatgtatatattcccagaaggcttatttaatgattgacctatcaccactgattattaatgtctgcatgaatgataacaataagaccaagtcatcaataatgcaatgaaaattttttaagtgaaagcaagtttattaagaaagtaaaggaataaagaatgcctacttcataggcagagcagcctaaaaaaaaaaaaaaaaaa

SEQ ID NO: 99 - DNA, 9454 bp, Homo sapiens
  misc feature (1)..(9454): GUCY1A3
cacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatattttcacagtgaagttaaatcatctgtgataggttccccagaccagcctacaaaggcccattaaatacagaataatttgtggatcttcaaagaggatgaacatacatttccatgacagagtccatacgaaattcacaatttagatgctaaaaaatttaaggaatatctttttttctctatcttatctgctttgaagcatagcgattagcgagaaacttttcagatccagaccactgatggtagccagagtagagaccctggagcatagattcttaaaataaataaggggcccaagtcagagctttgaggtattgaagatggaaaaatagtggacaaacagcctgtaatcaggttggggattacgggtactgagttatgttgccatttaactattctaaaaaataagactgggtctcaagactgcttccctaacagactgtttctcctgaaaatgcaggagctattctttctgttctggttatatagtttccattcatggcttcttgtcctgttgttttttgtgtcgagtacactatataaattatctccttatacatatttctcaggcaagcacagagttatactgaacttttctaaagatgctttgcatcaagaagcaaagggaaatacagaattaaaatgtttctttccattttgctttgtttttctatatcgatctagactttgtaggaaaatgcaaagcgtatatttaagaaaacctaaataagaatagattcatttactcattttcatttattcattcatgaagaatttattgaatgcctactatgtgccaggaatattgctatatttttgaaatttaaggataaaatatggcccaatctatcaagaaaggaaagtgaaagacaaatgtaagacataattacaacattctgtgggagcacaaagtaggggactcagttcttagagaagtcttttggtcttagagttcatcaagcagagaaggggaaggacatggtccaggaaaataaatcagcacacaaagagatggggtcttgagggtgcatagtacattctggacagccagttacctgggatgagttgggagggaggagaataaggacaaaagaccatctgggcaaaaatcacgaaggggtatgtgtgtcatgtaaaggtgtgccatgatagttattcatattgctattgtaatattaatatatagtaattaactacacatgacacagctttacatgaccttaagtagttatcaacattaccataatagtaatattaataactacaataagagccattattattcacttgaggcacttgttcaaaatagattttacaaaagaaaaaaaaaaaagaagcaacatgagtaaaattagatccattggctactgactccctctccaacagttttaaagctactagataagagaagcatcaagtcttaaaggaagagaatggtatgatcagatgtgtgttttccaaagactattagaaacagcatggttaaggatagggtggatatttacttgcacaggtgactgaatgaacatctgtttatacatcaagggaaaatgattcattttatatcctggatattttaccataagtatgagcataaagctgggatgtctggcattggaattttatgtcactctcaaggctaattagtctttcagatcctttggtagggaggaaagaagagttgcttcagcattttgactaacatttcttccaaatttcttctccctgatatttccagccacgccaaggcaaagacttcccagctctgtctcaggttaggttaaaagaaggcataggatggaagagggtggtctgtggtaggcctagcaaatgaaagagatgaataaacaagagtgtctagtctaactagtgcctgaggaatagacatcagtcctctgagattacccagctggaaaactgcccagatggagctttacatgcaaagctccagtgaagtctagtgctgtataatgctttaaatccacaatcaagcccttgttgatgcaaatgttagtcgcccaaagcagaatgggttaacgaattactgcagtggttttaggtgcatgggtttgacccatgtaaatcattttaataagtaaaattgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatgaaaaaaaaaaaaaaa

SEQ ID NO: 100 - DNA, 1386 bp, Homo sapiens
  misc feature (1)..(1386): HES6
ggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaaaaaaaaaaaaaaaaaa

SEQ ID NO: 101 - DNA, 3555 bp, Homo sapiens
  misc feature (1)..(3555): HHIP
ggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctag

SEQ ID NO: 102 - DNA, 3241 bp, Homo sapiens
  misc feature (1)..(3241): HNF1A
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccggcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaaaa

SEQ ID NO: 103 - DNA, 914 bp, Homo sapiens
  misc feature (1)..(914): HSPB1
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcaaaaaaaaaaaaaaaaaa

SEQ ID NO: 104 - DNA, 1402 bp, Homo sapiens
  misc feature (1)..(1402): ID2
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaa

SEQ ID NO: 105 - DNA, 7321 bp, Homo sapiens
  misc feature (1)..(7321): IGF1
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 106 - DNA, 2246 bp, Homo sapiens
  misc feature (1)..(2246): IGFBP4
aaagtccgggggagccggtcccgggcagccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgaaaaaaaaaaa

SEQ ID NO: 107 - DNA, 980 bp, Homo sapiens
  misc feature (1)..(980): IGFBP6
gcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgaaaaaaaaaaaaaa

SEQ ID NO: 108 - DNA, 1204 bp, Homo sapiens
  misc feature (1)..(1204): IL1R2
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggtttcgctcttccttttggagacagttatcactatgacccacataccacat

SEQ ID NO: 109 - DNA, 1147 bp, Homo sapiens
  misc feature (1)..(1147): IL22
cgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcc

SEQ ID NO: 110 - DNA, 1718 bp, Homo sapiens
  misc feature (1)..(1718): IL8
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 111 - DNA, 2308 bp, Homo sapiens
  misc feature (1)..(2308): IRX3
gcgaggagggggagtgaaaactagaggagggcgaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgccgtcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcggcccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcctgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataacccg

SEQ ID NO: 112 - DNA, 2075 bp, Homo sapiens
  misc feature (1)..(2075): IRX5
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaaaaaaaaaaaaaaaa

SEQ ID NO: 113 - DNA, 2729 bp, Homo sapiens
  misc feature (1)..(2729): ISL1
gaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaaaaaaaaaa

SEQ ID NO: 114 - DNA, 5988 bp, Homo sapiens
  misc feature (1)..(5988): JAG1
ctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcca

SEQ ID NO: 115 - DNA, 5845 bp, Homo sapiens
  misc feature (1)..(5845): JAG2
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaaaaaaaaaaaa

SEQ ID NO: 116 - DNA, 3338 bp, Homo sapiens
  misc feature (1)..(3338): JUN
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaaaaaaaaaaaaaaaaa

SEQ ID NO: 117 - DNA, 3508 bp, Homo sapiens
  misc feature (1)..(3508): JUP
tgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 118 - DNA, 7395 bp, Homo sapiens
  misc feature (1)..(7395): KIAA0182
aagcagtttagacaaacactgggcgacggtggctccagcatgtatcagccgaggtggagctgcggggccctggcatgaaaggcatgagccatgagcccaagtccccttcgctagggatgctttccaccgcgaccaggaccaccgccaccgtcaaccccctcaccccctcgccgctcaatggcgccctggtgcccagcggcagccccgccaccagcagcgcgctgtcggcccaggccgcgccatcctccagctttgccgccgcgctgcgcaagctcgccaaacaggcggaggagcccagagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgttaa

SEQ ID NO: 119 - DNA, 7080 bp, Homo sapiens
  misc feature (1)..(7080): KIAA1199
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggctggtccggcacccagactgcatcaatgttcccgactggagaggggccatttgcagtgggtgctatgcacagatgtacattcaagcctacaagaccagtaacctgcgaatgaagatcatcaagaatgacttccccagccaccctctttacctggagggggcgctcaccaggagcacccattaccagcaataccaaccggttgtcaccctgcagaagggctacaccatccactgggaccagacggcccccgccgaactcgccatctggctcatcaacttcaacaagggcgactggatccgagtggggctctgctacccgcgaggcaccacattctccatcctctcggatgttcacaatcgcctgctgaagcaaacgtccaagacgggcgtcttcgtgaggaccttgcagatggacaaagtggagcagagctaccctggcaggagccactactactgggacgaggactcagggctgttgttcctgaagctgaaagctcagaacgagagagagaagtttgctttctgctccatgaaaggctgtgagaggataaagattaaagctctgattccaaagaacgcaggcgtcagtgactgcacagccacagcttaccccaagttcaccgagagggctgtcgtagacgtgccgatgcccaagaagctctttggttctcagctgaaaacaaaggaccatttcttggaggtgaagatggagagttccaagcagcacttcttccacctctggaacgacttcgcttacattgaagtggatgggaagaagtaccccagttcggaggatggcatccaggtggtggtgattgacgggaaccaagggcgcgtggtgagccacacgagcttcaggaactccattctgcaaggcataccatggcagcttttcaactatgtggcgaccatccctgacaattccatagtgcttatggcatcaaagggaagatacgtctccagaggcccatggaccagagtgctggaaaagcttggggcagacaggggtctcaagttgaaagagcaaatggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgcagcctcttgggtgcttctctcctatctgtgcctcttcagtgggggtttggggaccatatcaggagacctgggttgtgctgacagcaaagatccactttggcaggagccctgacccagctaggaggtagtctggagggctggtcattcacagatccccatggtcttcagcagacaagtgagggtggtaaatgtaggagaaagagccttggccttaaggaaatctttactcctgtaagcaagagccaacctcacaggattaggagctggggtagaactggctatccttggggaagaggcaagccctgcctctggccgtgtccacctttcaggagactttgagtggcaggtttggacttggactagatgactctcaaaggcccttttagttctgagattccagaaatctgctgcatttcacatggtacctggaacccaacagttcatggatatccactgatatccatgatgctgggtgccccagcgcacacgggatggagaggtgagaactaatgcctagcttgaggggtctgcagtccagtagggcaggcagtcaggtccatgtgcactgcaatgccaggtggagaaatcacagagaggtaaaatggaggccagtgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactttgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtc

SEQ ID NO: 120 - DNA, 2949 bp, Homo sapiens
  misc feature (1)..(2949): KLF4
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 121 - DNA, 4553 bp, Homo sapiens
  misc feature (1)..(4553): KLF6
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgccaaaaaaaaaaaaaaaaaa

SEQ ID NO: 122 - DNA, 2855 bp, Homo sapiens
  misc feature (1)..(2855): KLK2
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 123 - DNA, 1099 bp, Homo sapiens
  misc feature (1)..(1099): KLK3
agccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgcccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctccca

SEQ ID NO: 124 - DNA, 1490 bp, Homo sapiens
  misc feature (1)..(1490): KRT19
agatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaaaaaaaaaaaaaaaaa

SEQ ID NO: 125 - DNA, 5034 bp, Homo sapiens
  misc feature (1)..(5034): L1CAM
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaaaaaaaaaaaaaaaaaa

SEQ ID NO: 126 - DNA, 2956 bp, Homo sapiens
  misc feature (1)..(2956): LBH
ggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttccactctgaaaaaaaaaaaaaaaaaa

SEQ ID NO: 127 - DNA, 840 bp, Homo sapiens
  misc feature (1)..(840): LCN2
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggccaaaaaaaaaaaaaaaaaa

SEQ ID NO: 128 - DNA, 3808 bp, Homo sapiens
  misc feature (1)..(3808): LCP1
caggtgatttttggtggggcggggacatgaaaaaaaagttaaaatgtccttataaagacaaaatctttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctataaaaaaaaaaaaaaaaaaa

SEQ ID NO: 129 - DNA, 1077 bp, Homo sapiens
  misc feature (1)..(1077): LECT2
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 130 - DNA, 3536 bp, Homo sapiens
  misc feature (1)..(3536): LEF1
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 131 - DNA, 2880 bp, Homo sapiens
  misc feature (1)..(2880): LGR5
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 132 - DNA, 4812 bp, Homo sapiens
  misc feature (1)..(4812): LRIG1
gcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcaaaaaaaaaaaaaaaaaaaaaaaaaaaaaaaaaaaaaaaaaaaaaaaaaaa

SEQ ID NO: 133 - DNA, 6641 bp, Homo sapiens
  misc feature (1)..(6641): MET
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 134 - DNA, 561 bp, Homo sapiens
  misc feature (1)..(561): MIF
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 135 - DNA, 3402 bp, Homo sapiens
  misc feature (1)..(3402): MMP2
atgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaaaaaaaaaaaaaaaaaaaaaaaaa

SEQ ID NO: 136 - DNA, 998 bp, Homo sapiens
  misc feature (1)..(998): MMP26
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaaaaaaaaa

SEQ ID NO: 137 - DNA, 1147 bp, Homo sapiens
  misc feature (1)..(1147): MMP7
accaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttaaaaaaaaaaaaaaaaaaaaaaaaaaaaa

SEQ ID NO: 138 - DNA, 2387 bp, Homo sapiens
  misc feature (1)..(2387): MMP9
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttaaaaaaaaaaaaaaaaaaaaaaaaaaaaaaaaaaaaaaaaaaaaaaaaaaaa

SEQ ID NO: 139 - DNA, 1017 bp, Homo sapiens
  misc feature (1)..(1017): MRPS6
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtaggaatgtgaaaaaaaaaaaaaaaaaaaaaaaaaaa

SEQ ID NO: 140 - DNA, 3309 bp, Homo sapiens
  misc feature (1)..(3309): MYB
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctacaaa

SEQ ID NO: 141 - DNA, 2731 bp, Homo sapiens
  misc feature (1)..(2731): MYBL2
gcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttaaaaaaaaaaaaaaaaaa

SEQ ID NO: 142 - DNA, 2379 bp, Homo sapiens
  misc feature (1)..(2379): MYC
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 143 - DNA, 2583 bp, Homo sapiens
  misc feature (1)..(2583): MYCBP
gcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagagagagacttggcttccttagttggtatgatagtttcttggtagatacaggttgaaaattttttgtggcagccaatcctcatgggctttttactcatttgattagtattaatatttatgtcagtaagccaggtgactgtgactgtctttggtaccatcctttttgaacagaaaggcaacatgtgggttggataatcacacttttaggtgaaactgacttgcttaaactgtaacagtcagtgctatttaagaattcaggataagcttagcctctagaggtcctcttcaacatttctgtcaaggatttggatgaatacaacaagatgctccatggaagagaaaatggataaatggatcccaccagttaagctcctattatgcttcagctgctttgtctataaaatatcgacttcacatcttgcctatctcacaagttggttgtaagaatcaaattaaatataatggatgtaaaagtgaaaaaaaaaaaaaaaaaa

SEQ ID NO: 144 - DNA, 2613 bp, Homo sapiens
  misc feature (1)..(2613): MYCN
gtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgaaaaaaaaa

SEQ ID NO: 145 - DNA, 7852 bp, Homo sapiens
  misc feature (1)..(7852): MYLK
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 146 - DNA, 2098 bp, Homo sapiens
  misc feature (1)..(2098): NANOG
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacat

SEQ ID NO: 147 - DNA, 3520 bp, Homo sapiens
  misc feature (1)..(3520): NDRG1
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 148 - DNA, 1056 bp, Homo sapiens
  misc feature (1)..(1056): NDUFV3
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 149 - DNA, 4090 bp, Homo sapiens
  misc feature (1)..(4090): NFKB1
gtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaaaaaaaaa

SEQ ID NO: 150 - DNA, 8716 bp, Homo sapiens
  misc feature (1)..(8716): NKD1
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcgtgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgccccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagatggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaagaaaaaaaaaacaacctc

SEQ ID NO: 151 - DNA, 4206 bp, Homo sapiens
  misc feature (1)..(4206): NOS2
ataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcaca

SEQ ID NO: 152 - DNA, 2281 bp, Homo sapiens
  misc feature (1)..(2281): NOTUM
gcgggccgcagccagcgcacccagaccctgcgctgccctcggacggccgggcgcggagccccagctgcggaggccgacggcacccggccccgagcgcctcgacgccgagccgcgcgcgccttctccgccaggcccggcgggcgggagcgggggcgagggagcaggagcggccagtgcccccgacacccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaaaaaaaaaaaaaaaaaaaaaaaaaaaaaaaaaaaaaaaaaaaaaaaaaaaaaaaaaaaaaaaaa

SEQ ID NO: 153 - DNA, 6305 bp, Homo sapiens
  misc feature (1)..(6305): NRCAM
tttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaac

SEQ ID NO: 154 - DNA, 7556 bp, Homo sapiens
  misc feature (1)..(7556): NRIP1
gcaggcgccttcgcggaccgagcctgacggagccggaggctgggagccgcggcggcctggggaagtgtttggattgtgagctatttcagaactgttctcaggactcattattttaacatttgggagaaacacagccagaagatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 155 - DNA, 1256 bp, Homo sapiens
  misc feature (1)..(1256): NTS
atagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaaaaaaaaaaaaaaaa

SEQ ID NO: 156 - DNA, 3443 bp, Homo sapiens
  misc feature (1)..(3443): NUAK2
gtgctttactgcgcgctctggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggcctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgccccgctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctgctcctccatcgcaaaggcatcctcaaactcaatggcaagttctcccagacagccttggagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttctcccccacctcccaggacctgcatcccagctcagaaggctgagagggtttgcagtggagccctgagcagggctggatatgggaagtaggcaaatgaaatgcgccaagggttcagtgtctgtcttcagccctgctgaacgaagaggatactaaagagaggggaacgggaatgcccgcgacagagtccacattgcctgtttcttgtgtacatgggggggccacagagacctggaaagagaactctcccagggcccatctcctgcatcccatgaatactctgtacacatggtgccttctaaggacagctccttccctactcattccctgcccaagtggggccagacctctttacacacacattcccgttcctaccaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaaaaaaaaaaaaaaaaaaaaaaaaaaaaaaaaaaaaaaaaaaaa

SEQ ID NO: 157 - DNA, 2102 bp, Homo sapiens
  misc feature (1)..(2102): OAT
ttgggggcggggcagaatcagcctttaagttgcagtgactctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtcaaaaaaaaaa

SEQ ID NO: 158 - DNA, 3747 bp, Homo sapiens
  misc feature (1)..(3747): PATZ1
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 159 - DNA, 3393 bp, Homo sapiens
  misc feature (1)..(3393): PDGFB
cctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctcactcgggctcgggatccgcccaggtagcggcctcggacccaggtcctgcgcccaggtcctcccctgccccccagcgacggagccggggccgggggcggcggcgcccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaatgaaaaaaaaaaaaaaaaaa

SEQ ID NO: 160 - DNA, 2301 bp, Homo sapiens
  misc feature (1)..(2301): PDZK1
tccagtgagttgcaagcctaatgctcacctgcagagacagaattcctgagtgaacgaacagagcagctcctcttccatctccagggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaaa

SEQ ID NO: 161 - DNA, 1383 bp, Homo sapiens
  misc feature (1)..(1383): PFDN4
aaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttcccaaaaaaaaaaaaaaaaaaaaaaaaaaaaaaaaaaaaaa

SEQ ID NO: 162 - DNA, 13037 bp, Homo sapiens
  misc feature (1)..(13037): PGR
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 163 - DNA, 3724 bp, Homo sapiens
  misc feature (1)..(3724): PIK3CA
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaaaaaaaaaaaaaa

SEQ ID NO: 164 - DNA, 2693 bp, Homo sapiens
  misc feature (1)..(2693): PISD
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaa

SEQ ID NO: 165 - DNA, 2579 bp, Homo sapiens
  misc feature (1)..(2579): PITRM1
tgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggcattttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctg

SEQ ID NO: 166 - DNA, 2012 bp, Homo sapiens
  misc feature (1)..(2012): PKIB
gactgcgcatgcgcgtcactagacgacacggctgtcttctttcctggagaatttctcaaggactgctggctggaaacttaacggctaatgtggatctgaccgtagtttgccaaattaagaaaacgtttttaccctgttgaagatttgctttaacttcaaaagtgatgacaagaaagtatggacaccccttcaggaccaacctgataagtcactgagacggggtttcaccgtgttagccaggatggtcttgatctcctgacctcgtgatccgcccgcctcggcctcccaaagtgctgggattacaggcgtgagccaccgcgccccggcagcaaaggtttttctttcgtttaaagatgacacactctgaaattaatttgattttgagatttgagaacttggacatacatacttcctatggaaggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactgaaaaaaaaaaaaaaaaa

SEQ ID NO: 167 - DNA, 2395 bp, Homo sapiens
  misc feature (1)..(2395): PLAU
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgacaaaaaaaaaaaaaaaaaaaa

SEQ ID NO: 168 - DNA, 1570 bp, Homo sapiens
  misc feature (1)..(1570): PLAUR
gccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggccaaaaaaaaaaaaaaaaaa

SEQ ID NO: 169 - DNA, 4934 bp, Homo sapiens
  misc feature (1)..(4934): PMEPA1
aaacccgatctccttggacttgaatgaggaggaggaggcggcggcggcggcggcggcggaggcgctcggctggggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgagaaaaaaaaaaaaaaaa

SEQ ID NO: 170 - DNA, 1411 bp, Homo sapiens
  misc feature (1)..(1411): POU5F1
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 171 - DNA, 1638 bp, Homo sapiens
  misc feature (1)..(1638): PPAP2A
tcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaaaaaaaaaaaaaaaaa

SEQ ID NO: 172 - DNA, 3749 bp, Homo sapiens
  misc feature (1)..(3749): PPARD
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaaaa

SEQ ID NO: 173 - DNA, 1818 bp, Homo sapiens
  misc feature (1)..(1818): PPARG
ggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 174 - DNA, 4710 bp, Homo sapiens
  misc feature (1)..(4710): PRDM15
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggatac

SEQ ID NO: 175 - DNA, 4499 bp, Homo sapiens
  misc feature (1)..(4499): PRKACB
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaaaaaaaaaaaaaaaaaa

SEQ ID NO: 176 - DNA, 3088 bp, Homo sapiens
  misc feature (1)..(3088): PROX1
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaaaaaaaaaaaaaaa

SEQ ID NO: 177 - DNA, 7957 bp, Homo sapiens
  misc feature (1)..(7957): PTCH1
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 178 - DNA, 3773 bp, Homo sapiens
  misc feature (1)..(3773): PTCH2
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgat

SEQ ID NO: 179 - DNA, 1223 bp, Homo sapiens
  misc feature (1)..(1223): PTMA
cccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaaaaaaaaaaaaaaaaa

SEQ ID NO: 180 - DNA, 3318 bp, Homo sapiens
  misc feature (1)..(3318): PTPN1
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 181 - DNA, 728 bp, Homo sapiens
  misc feature (1)..(728): PTTG1
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 182 - DNA, 1785 bp, Homo sapiens
  misc feature (1)..(1785): RAB34
aggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcacttaaaaaaaaaaaaaaaaaaa

SEQ ID NO: 183 - DNA, 3301 bp, Homo sapiens
  misc feature (1)..(3301): RARA
gtgcctcttgcagcagcctaacccagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattctaaaaaaaaaaaaaaaaaa

SEQ ID NO: 184 - DNA, 812 bp, Homo sapiens
  misc feature (1)..(812): REG1B
gatataaagctcctactctgtctgacctgacaagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttatttttatccagtgaaaaaa

SEQ ID NO: 185 - DNA, 830 bp, Homo sapiens
  misc feature (1)..(830): REG3A
caaaccataccatatcccaccagagagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgcaaaaaaaaaaaaaaaaaaaaaa

SEQ ID NO: 186 - DNA, 1343 bp, Homo sapiens
  misc feature (1)..(1343): REG4
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccatgggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 187 - DNA, 2325 bp, Homo sapiens
  misc feature (1)..(2325): RERG
actgcagcatcctggccgctgagcgcagcggccttggccgggctcagctcgcgtcctgccgcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtcat

SEQ ID NO: 188 - DNA, 5629 bp, Homo sapiens
  misc feature (1)..(5629): RET
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaaaaaaaaaaaaaa

SEQ ID NO: 189 - DNA, 4573 bp, Homo sapiens
  misc feature (1)..(4573): RNF43
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 190 - DNA, 361 bp, Homo sapiens
  misc feature (1)..(361): RPS27
ctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaatcctgaaaaaaaaaa

SEQ ID NO: 191 - DNA, 5720 bp, Homo sapiens
  misc feature (1)..(5720): RUNX2
ggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgttaaaaaaaaaaaaaaaaaaaa

SEQ ID NO: 192 - DNA, 3487 bp, Homo sapiens
  misc feature (1)..(3487): SALL4
atgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaaa

SEQ ID NO: 193 - DNA, 3804 bp, Homo sapiens
  misc feature (1)..(3804): SBSPON
gggcagccccgccacccgcccgggcctcgacgggcgcgccgccagggctggggaggggcggcgcggagggcgggggccgggcgcagggcagggcccggctgtgcctcgccggccgctcgggcagctcccgggccgcggccagccgaggatcagagcgcttgccccgggggtctgtcgcgtcgcaggcgccgccggagccctggccatgaggaccctgtggatggcgctgtgcgcgctgtcgcggctgtggcccggggcccaggccggctgcgccgaggccgggcgctgctgtcccggccgggaccccgcctgcttcgcccgcggctggaggctggacagggtctacgggacgtgtttctgcgaccaagcctgtcgcttcaccggggactgctgcttcgactacgacagggcgtgcccagctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcagggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatagatggtgatataaatatttccaaatgcatttgtaaacattctaaatattctcaagtcatgttcaatgtttcctaaaccttcaattttggccaaagtccccaaacacatcattgccacactctgaagtagagaaagaaaatttaggggccagttctcaaggaacacaggtcctttatttttattttaactaagttgaagacccactcaaaaagctcttgtggttttatgttcttgacctttcaactggagtcctctcattcagcaggtggcccgtgagacacagaatacatgtctgtttgctaaagtaaaattactgtaactcagtccgattattggtgacggaagtgtcatttaaggggatctatgttttgaaccttgcagtctattttataatcttttaaaagtttctcactttaaaacatgtatacaggtatgcacactctacacatatatttccatatatttaatattccataaattctgaaataatttcaagcaaattatcacaaataatttttccacagggcaaattatttaaaattttagtaagcattctgtaatgaaaaaccaagttatactaaaaacattttttgaagaagaaattttttttttgcttaagaagtgaaaggatcaaatgctcattgtaggtcaatgggagttcttttaaatgttataattttcatgaaaagaaatgttgacaccagtgaatgaaacaattgctttcattctgaaaattctaccaccatttgcatctaagattatttccaaggcttaaagcctgaagctgaataaaataatctttcagagtccagcttcaagtttagttgatgtaagctcactatttttttcctaccgcatgcattttctaatgtttggggtggatggtgtgtcggttatggaaggcatagacgtcattacaggtgctacgatctcacacacacacaaggaaatgttagtctccttattttatgattggaaaatcaatgacctagaggcaaaatggcatgtttaaggacctgggatgacaagtcattctgcagtcagccacagagccaaatttggactcctcaaccagaactccatgaaaagcctgactttgccaaacactgtgctggaaaagctaagcccctttcatttgtgaagtaaattttaaattcaagatatttagtttagagaattgagtcttgagatgtaaactacatgagatttctttggtttcaattgaataatattcactaacaaatgatttactaaaatacgtatttcttggtccttatcatgtaatgacagattcacaacagcaataaggatggagatttccccaataattaataacaccgagagtagcaatattttttactgtattttcatttaattgtcaaagttgtttttgtggaaaattaaattcttcagaaattaataataaaatatgtgagtctcatcaaggctagcaactttaagtcagtattaacattttcatactgtttctaacatttattaagctagatttttgaagctatgtctgggtaatttccaatgttacttaaaagtttttttttctttgagacagagtctcactctgttgcccaggctggagtgcagtggccccatctcggctcactgcaagctccgcctcccgggttcacgccattcttctgcctcagcctcccaagtagctgggactacaggcgccgtcatcacgcctggctaattttttgttttttttttttagtagagacagggtttcactgtgttagccagggtggtctcgatctcctgacctcgtgatccacccacctcggcctcccaaggtgctgggattatgggcgtgagccactgcgcctggcctgttacttaaaatttttatactagtaaataaactttttgttcacatttataaaagctctatatttgtttgactagaaaataacccaaattttctggaccagtcagagaatgataaaatttcaccaaaaataaaacaaaaaaatccttcagaactgataggtataggtacaacaactactaatagcaataaagcaatggtgcttttatagttccgatatgtgttataacatttaacataattgaggtgtataaaataaatttttcaccttatgcatttaatttttggtggatgaccagtaattgctttcttattgaagttaaatttttgttatttctattcttgagaaaattttatgggctagaggagttaactgttaaataacagttttgaaaagcttgttattaattttagcaaagcccaagggaaatagttcagaactgaaacatgtagtccaagtgatgaatgaaaaaccaaaagtttttattttcaaatttaaaaatcaaagtatataagacctcttggcactcttttttaataagtaccttagtcttagggccctatccccaggcactctaaaaagatttacgaactctaaaatcccttaatagactgattttcaaaagtgctcatggaaaataattcgaacaaaaataaatacagccaccaggaaagaagggaaaagaagcaagggataatggccatttttgaagagaaaagtgaaaaacaagtgaaggaaaaaaagaatagaaaaaggaataaggtaactataatcacagtattctttttggagttttgctttggtttttattcgagaatgttacaattaagcataaaccgcaacagcaataatttaaagtgtttggttatcatctggcataaaaatttcagttagctatcttttctagatgtgcacaaaattgatgttaataaaactggttcctgccctctaaaaaaaa

SEQ ID NO: 194 - DNA, 4298 bp, Homo sapiens
  misc feature (1)..(4298): SFI1
ggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaa

SEQ ID NO: 195 - DNA, 3208 bp, Homo sapiens
  misc feature (1)..(3208): SGK1
agatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttacatataaaaaaaa

SEQ ID NO: 196 - DNA, 4483 bp, Homo sapiens
  misc feature (1)..(4483): SGK3
actgcgggcggagcagagggaaacaccagagtctgtgactccagacaggacccactgtgtcctcttgaactttgcacagcgcgtgacgggggcagacggtgcaccgtggcccggcctttcgcgggggtcctcggggaagagagaggagcgcgggtttcctcggaggcctgagcgggacgcagcctgcagcccctccccgcacgggctgcccccggcccgccgctcgcgccgctctgctgggatccggcgccttccccggctgtcctcggcctcccgcgcgctccgcgggaggagccgccagcggccgtgacgcgtcaaggaggaaacgccggcgcccggcggccctgccgggaaggaggaagcgcagtgcgttcggctccgcgcccgccgcgccgggagcagcaccgcggggccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaaaaaaa

SEQ ID NO: 197 - DNA, 1576 bp, Homo sapiens
  misc feature (1)..(1576): SHH
gcgaggcagccagcgagggagagagcgagcgggcgagccggagcgaggaagggaaagcgcaagagagagcgcacacgcacacacccgccgcgcgcactcgcgcacggacccgcacggggacagctcggaagtcatcagttccatgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctgaagccggggggccgggggaggggcgcgggagggggcg

SEQ ID NO: 198 - DNA, 4706 bp, Homo sapiens
  misc feature (1)..(4706): SIK1
cgcggccccggaggcagcagcagcggcggcggcagccggagcagtaggcacccgagcagcgccagcggccgagcgggcggcttcctggcctgggcgctccggtggcggcggaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgcctcaggaaggtctttccaccgaccctttccgacctgccttgctgtgcccgcagccgcagaccttggtgcagtccgtcctccaggccgagatggactgtgagctccagagctcgctgcagtggcccttgttcttcccggtggatgccagctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagcttccaggagggacggcgggcgtcggacacctcactgactcaagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaa

SEQ ID NO: 199 - DNA, 3757 bp, Homo sapiens
  misc feature (1)..(3757): SLC1A1
agagcgcggcggcagcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttcaaaaaaaaaaaaaaaaaa

SEQ ID NO: 200 - DNA, 12021 bp, Homo sapiens
  misc feature (1)..(12021): SLC1A2
gggtgatgtcagctctcgacgaaaatagagagggatcgcctgcaaatccccagctccggcggggctaaaccttgcaatccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaaggtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcctgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattatatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatgtatagatttatcctaattggttcaacatatatatgaatgcttgtaatagtctgttactatttgataatgcataaatgttatatttatatacagttacagcaggccagaaacatacatacactgcatcctgtaaggtctgtaaatcagggcttcggcaatgccattttgctatagactcattcatgttttttaggaatcagaatcatttcaggagaaaaccaactaagtagactttaattcttctctttctcattcttgccctttgagaaacccaagtggaatcatcacttaattacttactcaaattcaatgaatcaaatccaatccaatcagtgagaagaatagcttatctttcaaggtaatactttaccttagatctttgagggcatgcttcccatacaaagagcatcagaaaatcagggcaatcatctagatctcacagatcttcaacataggactctaggttatgagagctgaaccacatagctatcagtttcagtttttacttcctattgagtgtgtagaaacacagcctatggttttgctgtctgcggaagttaccataccctgtaaaagacaaatatttctttctcctctcgaaccactagtcagcctggatattcatgaaagctgaaagaaggggtgccaaaatgcctagctcctggatttagactcatggaatatgagaaaggcttagggaaaattcaagtcatggggagattcctgctaggtgatgccaggaatctcaatgacctgttgattagagggtctctggtcatttccacttgtgtgtggagaaatacatcatttgcatatgtatctagtcaagaagcccttttggagcaaagtggttgggaaactcatttactgggtccaccaaaggaaacccaattctgccatgtttttgcaaatactacacgtccctttgctctcaatagcaaaagtgatgttatagttttttttacttttgtcagaatcaaggcttcggccacctgtgcaatattttcccatggaatgcagcagtaaatccaagtaggtatatccgtgctcagagagaattctccatagttctgactcctgaaaaacaagtctcattagctctcatctagtttgatgactaaaagtgcacagcagttataccccagtggaagtgatttttctcacctagctgctctctaactcttacggctatctagttgtctgagctgctggtttgttttacttattctccaactgaactcattccaaaccaagaaaaaggaccaaatgaaattttcagttattatcatacttgctccttgaataagaatgctagagtctggaggcagaagaagactaagttaaaaaaaaaacagcctgaaggaattctggagtgagttttgtaagtctaattgtcaaagaagataaatggtctcagtatctgtagtaatttctggttaagcctagagggatcactgagtgccaatccaagcaggtggcactagaggcagattgttctcctagcatagagtgagtttccagctgctcatgacacattttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtacaacacttgcacaatcacggcaactgtttgtaaatatcttttcttctccgccagtatgtagacatgcacacccattcacaagtaagcccgcaaattcattttcacattttcctcttggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaatttaaaaaaaaaaaaaaaa

SEQ ID NO: 201 - DNA, 4543 bp, Homo sapiens
  misc feature (1)..(4543): SLC7A5
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 202 - DNA, 1722 bp, Homo sapiens
  misc feature (1)..(1722): SNAI1
attcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaaaaaaaaaaaaa

SEQ ID NO: 203 - DNA, 2112 bp, Homo sapiens
  misc feature (1)..(2112): SNAI2
aaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaa

SEQ ID NO: 204 - DNA, 1713 bp, Homo sapiens
  misc feature (1)..(1713): SNAI3
cagcagtccggacccaggcgcgcccctcccgccccagcccaccccggcctgccgcccgggaggggaacatgccgcgctccttcctggtgaaaacgcactccagccacagggtccccaactaccggcggctggagacgcagagagaaatcaatggtgcctgctctgcctgtggggggctggtggtgcccctcctcccccgagacaaggaggccccttctgtgcccggtgaccttccccagccctgggaccgctcctcggccgtcgcctgcatctccctgcccctcctgccacggatcgaggaagctctgggggcctctgggctggacgccttggaagtcagcgaggtcgaccctcgggccagccgggccgccattgtacccctcaaagacagcctgaaccacctcaacctgcccccactgctggtgctgcccacacggtggtccccgaccttgggcccagaccggcacggggctccggaaaaactgcttggggctgagcggatgccccgagccccgggcggctttgagtgcttccactgccacaaaccctaccacacgctggccgggctggccaggcaccggcagctgcactgccacctgcaggtggggcgtgtcttcacctgcaagtactgcgacaaggagtacaccagcctgggtgccctcaagatgcacatccgcactcacacgctgccctgcacctgcaagatctgtggcaaggccttctccaggccctggttactgcagggccatgtccgcacccacacaggggagaagccctatgcctgctcgcactgcagcagggcctttgccgaccgctccaaccttcgggcccatctgcaaacgcactcagacgccaagaagtaccggtgccggcgctgcaccaagaccttctcccgcatgtccctcctggcgcggcatgaggagtctggctgctgcccgggcccctgagaggcacgtggtcggcgcaggtaggagggatggtcctcaccgggagagctggcgtccctcctgcccccagaggagccaggagtctgggagggcggggcctggcctcacacttggtgcgtcctccacatctgcgtccaatcagaaccaaagaagtccagcgggggccactgggccggaggacactcccccaggcatcccaccgcgcggagcccactcagaggagactcctctcccggggaaggctttcatcagaacaagagccatggttccatttcgacacggccaggtctccggggctacccttccaagagtcagagcctcggggaggtggccgccagcatgggccggcactgccgccggatggctggcaaggctgcctagttccattgcagcagaaatgaacagttctgacttatagtgagcaccgccctgtggcccttcctcagtaggcacaactacctctcagccagcccccgccagcctttggtttggggtctgggacgagctgccccatgtcacacgtctatgtgcatgtgcacacacactcaaacatgtacacacacgtgccctccccacctcactagactctccgggagatggggcaggactgggagagcccacgattggtgatttgggtgtgttgggatgaggcggagtgcctgtgggatttgtcccggtcagagcctcagggggctggggtctcagggcactcagcttcccaggcaataacagccgtggggtaataaatggtctctgcacacctgca

SEQ ID NO: 205 - DNA, 981 bp, Homo sapiens
  misc feature (1)..(981): SOD1
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaaaaaaaaaaaa

SEQ ID NO: 206 - DNA, 2350 bp, Homo sapiens
  misc feature (1)..(2350): SOX17
gcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgcttttttgctctactagtacctctgtcacactagtcttatcaaaaaccagttcttaagatcaatgttaagtttattagttaatgtaaatttctcatcctcgaaaagggtgaacataaatgcctttaaggagtatatctaaaaataaacattaggatatctaagtttgatgtaattgtttcaggaaggaaaaaagaaaagcattctggaatgagcctacttcaagtaatcttagtttctaaaactaacagttaatattttcaattccagtatatcactttaagtagaaggggatgtccaagtaattttggttttctaactgttgaatcataagcttgacctgcccccagaggctttttggatgtttttatctgtgttttgccatctctttacactcctcgacattcagtttaccttaatcttcacatttttacaccttgggaagtggcaagcatcgctgggtttaagataaaggagtcacaaaaactaatcaaaataaaatttgcattatgacaacttttaataca

SEQ ID NO: 207 - DNA, 2520 bp, Homo sapiens
  misc feature (1)..(2520): SOX2
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaa

SEQ ID NO: 208 - DNA, 4912 bp, Homo sapiens
  misc feature (1)..(4912): SOX4
attggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaaaaaaaaaaaaaaaaaaaaaaaaaaaaaaaaaaa

SEQ ID NO: 209 - DNA, 3963 bp, Homo sapiens
  misc feature (1)..(3963): SOX9
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 210 - DNA, 1963 bp, Homo sapiens
  misc feature (1)..(1963): SP5
cggggcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgaaaaaaaaaaaaaaaaa

SEQ ID NO: 211 - DNA, 3642 bp, Homo sapiens
  misc feature (1)..(3642): SP8
atcattgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaacggccactggaggtagagctggactaatccagtgcctggtagacagcgggcctcgcgcgggcaggagcggctcggctgacaagcctgagcggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgacttttggcagcccgagacccagagtttgtagagtttagatctcccaatgtcagtctgcctctttttctttgttccctgaggtggaaccgatgcaagtttcagcaaagggcagtcttgtcgaatcgctgcagcagctttctttcatctttatagcatatattttatttttaaaaaaactagggggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaattgtatagtaccaatttcgtaaattctctcaattcatgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgattttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatattgataaatgttggatgacatttaatttaatggagcatgtacttatttgcatttgctggcagttcaggcatagttaaagtgagagttctcctatatttcataataagtggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtataataaactcagataaaagactaggccaaaaaaaaaa

SEQ ID NO: 212 - DNA, 1616 bp, Homo sapiens
  misc feature (1)..(1616): SPP1
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaa

SEQ ID NO: 213 - DNA, 5468 bp, Homo sapiens
  misc feature (1)..(5468): SRSF1
gttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaaaaaaaaaaaaaaaaaaaaaaaaaaa

SEQ ID NO: 214 - DNA, 3916 bp, Homo sapiens
  misc feature (1)..(3916): TACC2
ccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaaaaaaaaaaaaaaaa

SEQ ID NO: 215 - DNA, 4814 bp, Homo sapiens
  misc feature (1)..(4814): TBX3
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 216 - DNA, 1661 bp, Homo sapiens
  misc feature (1)..(1661): TCEA2
cggccgctgggtccgtgaaggggagtgaggcactcctcaccctgtggcagctcctagtcaggaggcctctcccctccacctgcacgtcatgtggctgtggctcccaggaccagcgcctggagcgggtgagtgaacgtccctctcctccgtgggcactgcctccgctgtgagccacccttcaggctacgtgcatttccgcctgttctcagggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaacaaaaaaaaaaaaaaaaaa

SEQ ID NO: 217 - DNA, 4451 bp, Homo sapiens
  misc feature (1)..(4451): TCF3
acgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatgc

SEQ ID NO: 218 - DNA, 8320 bp, Homo sapiens
  misc feature (1)..(8320): TCF4
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 219 - DNA, 4004 bp, Homo sapiens
  misc feature (1)..(4004): TCF7L2
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 220 - DNA, 2174 bp, Homo sapiens
  misc feature (1)..(2174): TDGF1
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 221 - DNA, 508 bp, Homo sapiens
  misc feature (1)..(508): TFF1
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 222 - DNA, 4323 bp, Homo sapiens
  misc feature (1)..(4323): TGFA
gtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaaaaaaaaaaaaaaaaaa

SEQ ID NO: 223 - DNA, 2217 bp, Homo sapiens
  misc feature (1)..(2217): TGFB1
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggaaaaaaaaaaaaaaaaaa

SEQ ID NO: 224 - DNA, 7218 bp, Homo sapiens
  misc feature (1)..(7218): TIAM1
gccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgaaaaaaaaaaaaaaaaaaaa

SEQ ID NO: 225 - DNA, 3250 bp, Homo sapiens
  misc feature (1)..(3250): TMPRSS2
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaaaaaaaaaa

SEQ ID NO: 226 - DNA, 1669 bp, Homo sapiens
  misc feature (1)..(1669): TNF
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaa

SEQ ID NO: 227 - DNA, 1625 bp, Homo sapiens
  misc feature (1)..(1625): TNFRSF19
gttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggtaaggcagcgactgggttccctgtgaacacagcactgacttacagtagatcagaactctgttcccagcataagatttgggggaacctgatgagttttttttttgcatctttaataatttcttgtatgttgtagagtatgttttaaaataaatttcaagtatttttttaaaaaact

SEQ ID NO: 228 - DNA, 2216 bp, Homo sapiens
  misc feature (1)..(2216): TNFSF11
cgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgcaaaaaaaaaaaaaaaaaa

SEQ ID NO: 229 - DNA, 2396 bp, Homo sapiens
  misc feature (1)..(2396): TOM1
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaaaaaaaaa

SEQ ID NO: 230 - DNA, 5744 bp, Homo sapiens
  misc feature (1)..(5744): TRIM25
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 231 - DNA, 3037 bp, Homo sapiens
  misc feature (1)..(3037): TRIM29
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaa

SEQ ID NO: 232 - DNA, 3214 bp, Homo sapiens
  misc feature (1)..(3214): TSC22D1
gtggcgtgccggccaatcggcgcagctctttcctgcatatattttgcactaagactgggagtcctggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 233 - DNA, 3406 bp, Homo sapiens
  misc feature (1)..(3406): TSPAN5
aggcgggcggagcgaggggtgggagggcgcgcgcgaacgggcgggcgagcaagcgagcggcgtctccaccagcatctgccgcggccgcctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctaccttaaaaaaaaaa

SEQ ID NO: 234 - DNA, 5217 bp, Homo sapiens
  misc feature (1)..(5217): TTC9
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcccggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaacaaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatgctatacttagttgcctctctgtaagtataatattgggcaattataaccatttgagaacaggacaatatgtattaacctgaaaagtgttcatgatgtcagtgatagtacatggcctccttatgtatttactcaagggccccaaaagaccagaggccagaatccctagtagtcagagcagtgacaggtcagaaaaaggcagctgaggtccaatagttatgtctgtgtattgctcattctacttactgatggagccagcatgtatctcaacaactcacctagcattcatcacccatccccagcattgggaaagggtcacaattaagaccgaaaggaaacacaaagttaaatatgggttaattatgtaagcagatgccccaccacggcaggatccaatcacagccgaggggcccagaagagagcagcgtaagttatattcacatagttccccaaaggctttcaacgggggctacaggaaggtgctagaaatattgaggggcctgccattactcacctagagctcactctctggagaagaggaaaaggaagaagctatttcagctgccacattctccccaatccctactatattatgctgtctttcctcttcctcctagctggctttacatgaccctaacccaaaactaccctatggccccacacgggaatgtgttcaaacgccccgacccccacccccacccccattcccaagcctccaacttagaacgtttgtgatttggcagatggtttgttaggatctgaaggatgaagagaagggtagaggtcacctggagaatgagttcaaactgccagggtcttcccttggtctttgtgcgtcaggaaggactccgagtaattattccctatgcagagacaggagagaggtcttgtttacatgagtgtgctggggcagggctggacaatccaggatatgattgtagccatcccatgtagaaagatcaaaaaccagaacgaaatgaagacagcctctcagaacctcatagaacaagcgtccaggtcatctgcttgtttggtgacttagatatacaggcttactggaactccattcactgtgacctgaagttaaataatcccaaagagaaaaagctacctggggtattggttgatgtttggggtgatagggctgaattttctgtgcatttgtccaacaaaggctttagagcacaaaaccaggttcattctccctaccaaatcttcagcttccttctcctcatccctccccaaaacaagaactgtgatttaattccgtacgttgcggatgtcactgctgacctatgtagctggagtactaatcaggcatctgacctgcactgtcatcccctgcctggacttttgcgatggactctttgggggaaaaactaacgctttttaattattgtgaaagcatcatgtgtgtattgtagaagttttaggaaaaaaaggacaaaatccaatccataagcttaccacccaagacaaacgtgtattcttttgaatataccttttagttctttttggtgtaaatgtacacacgcacacacagttgtggatttttttaaacaaaaactggatacactgaatatactctttaataacttttcaagtgtgtatttatattttagaatatgtaatcctacacagatacaaaattcaaaaagtacaaactgctctgtagtcagaagtaaatcttctccctaccccgtctgccagcatctagtttccctctaatttattttgcatcctagtggagatgcttacacattgtcaaacatatgtatatattcttttatcacacacaaatggcagcatattggacactttttgttttttgctccttctgttccttcacttaataatatcacgaacattttcggcatatcaaactttctcaacagcatcttcattgtatggatggaccctttttttatcatcaatcctcaaatagtgattatttcatttgttcccaatcttcattgtaaatagtgttgcaactgacattcttgtagctaaattttgcacatgtctataacgatttccttaggataaactccaagaagagacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattcttaattctgc

SEQ ID NO: 235 - DNA, 1930 bp, Homo sapiens
  misc feature (1)..(1930): TUBA1A
ataatggatgctcggccgactgcttctgcacggtctctttgtctaaaggatgcaaacagtctacggatgctagagaaaaaggggtgggggagagattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatgaaaaaaaaaaaaaaaa

SEQ ID NO: 236 - DNA, 2264 bp, Homo sapiens
  misc feature (1)..(2264): UGT2B15
ggtctccttggcatgcacctattcagactgttagtattatgtatttacttcaaattttagcagttatattttaacttgattgatttttcctcagatataagtatgagaaatgacagaaagaaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctgaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaatacaactcttttttttaaaccaggaaggaaaatgtgaacatggaaacaacttctagtattggatctgaaaataaagtgtcatccaagccataaaaaaaaaagaaaagaaaaataaaaataatataaaaccttaaaaaaa

SEQ ID NO: 237 - DNA, 12416 bp, Homo sapiens
  misc feature (1)..(12416): VCAN
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 238 - DNA, 3677 bp, Homo sapiens
  misc feature (1)..(3677): VEGFA
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 239 - DNA, 1822 bp, Homo sapiens
  misc feature (1)..(1822): VEGFB
gccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcaaaaaaaaaaaaaaaaaa

SEQ ID NO: 240 - DNA, 2076 bp, Homo sapiens
  misc feature (1)..(2076): VEGFC
cggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattat

SEQ ID NO: 241 - DNA, 1433 bp, Homo sapiens
  misc feature (1)..(1433): WISP2
tgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgaaaaaaaaaaaaaaaaaaaaaaaaaaaaaa

SEQ ID NO: 242 - DNA, 2375 bp, Homo sapiens
  misc feature (1)..(2375): WNT10A
acagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggagcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggattaaaaaaaagaaatagacataactgagctgaagtaattccataaagggcccagacagcctcctccaccattcccttcatcattcatttaacaaatatttattttgcactctctttgcggcactctgggggcggtggggtgcgtgggggtggcaatgcaaggcactgaggccacagatgtgagtaagcgagacacaacacttgtcctcttggaggttacattcttgctggggggaggcatgggcaataaacaagtaaatatacaaac

SEQ ID NO: 243 - DNA, 2988 bp, Homo sapiens
  misc feature (1)..(2988): WNT3A
gcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcggagcgcctccttaggagtggggttttatggtggatgaggcttcttcctggatggggcagagcttctcctgaccagggcaaggccccttccacgggggctgtggctctgggtgggcgtggcctgcataggctccttcctgtgggtggggcttctctgggaccaggctccaatggggcggggcttctctccgcgggtgggactcttccctgggaaccgccctcctgattaaggcgtggcttctgcaggaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagggcctcccagcccccaaccccaagaccaagcttagtcctgggagaggacagggacttcgcagaggcaagcgaccgaggccctcccaaagaggcccgccctgcccgggctcccacaccgtcaggtactcctgccagggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctctgccactgtgaaccggctcccaccctcaaggtgcggggagaagaagcggccaggcggggcgccccaagagcccaaaagagggcacaccgccatcctctgcctcaaattctgcgtttttggttttaatgttatatctgatgctgctatatccactgtccaacggagttagacgaaaaaaaaaaaaaaaaaa

SEQ ID NO: 244 - DNA, 1820 bp, Homo sapiens
  misc feature (1)..(1820): XBP1
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 245 - DNA, 4685 bp, Homo sapiens
  misc feature (1)..(4685): YES1
ggaggaggtggagagtgaggccgaggcgtggggagcccgggaactccctcctcctgaagtaacgcgtcccgggccggctctgccgtcgttgctgccgccgggcgccccgggacgaggaggtggaggagggagagggcccgcgggcctcgcctccgccctccgccacctcgagctgcggtagcagcgactcatgagagcgcggccggaggacagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatctgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaa

SEQ ID NO: 246 - DNA, 4188 bp, Homo sapiens
  misc feature (1)..(4188): ZBTB7C
aatttggtgtcataaagtgaagcgtaacgcgcgagtggtgagatcgtcctgtcctgcgcttaacagtacaggtggaccaaaggggctcccggccaaatacttctggttggagggtggggagggagtgctctctcaaaaccactcctggaatggcttaactcgcccagcacgaatcaatgacaacctcccgccggctgcggcaggctcccgcgagcagcgcggccgcgtggattcccagcccgggaccctggcggcgctcaggacacggcccgggcacgagcgcggcgtccccggggcggccagggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatgaaaaaaaaaaaaaaaaaa

SEQ ID NO: 247 - DNA, 2548 bp, Homo sapiens
  misc feature (1)..(2548): ZNF600
gcgcacaaacccggaagcggatcgcgtggagtgaaggtcctaccacggcgcgtgagttttgctctgccttggattaagtctgcacttcccaggtccccggcgcttctgcccctgggacgtgggatccccacggacctggaaattctcgcctgtcttcccttcacccagagcaaattgagacgtcccggattgattcctaaagactcatgttatgtgaagaagcagctcagaagaggaaaggaaaggagccaggcatggctcttcctcagatatctcttccaaacgcatgatgaaggaggtcttgtcaacagggcaaggcaatacagaagtgatccacacagggacattgcaaagatatcaaagttatcacattggagatttttgcttccaggaaattgagaaagaaattcatgatattgagtttcagtgtcaagaagatgaaagaaatggccatgaagcacccatgacaaaaataaaaaagttgactggtagcacagaccaacatgatcacaggcatgctggaaacaagcctattaaagatcagcttggatcaagcttttattcacatctgcctgaactccacataattcagatcaaaggtaaaattggtaatcaatttgagaagtctaccagtgatgctccctcggtttcaacatcccaaagaatttctcctaggccccaaatccatatttctaataactatgggaataattccccgaattcttcactactcccacaaaaacaggaagtatacatgagagaaaaatctttccaatgtaatgagagtggcaaagcctttaattgtagctcactcttaaggaaacaccagataccccatttaggagacaaacaatataaatgtgatgtatgtggcaagctctttaatcacaagcaataccttacatgccatcgtagatgtcacactggagagaaaccttacaagtgtaatgagtgtggaaagtccttcagtcaggtatcatcccttacatgccatcgtagacttcacactgcagtaaaatctcacaagtgtaatgagtgtggcaagatctttggtcaaaattcagcccttgtaattcataaggcaattcatactggagaaaaaccttacaagtgtaatgaatgtgacaaagcttttaatcagcaatcaaaccttgcacgtcatcgtagaattcatactggagagaaaccttacaaatgtgaagaatgtgacaaagttttcagtcggaaatcaacccttgagtcacataagagaattcatactggagagaaaccatacaaatgtaaggtttgtgacacagctttcacatggaattctcagctggcaagacataaaagaattcacactggagagaaaacttacaagtgtaatgagtgtggcaagaccttcagtcacaagtcatcccttgtatgccatcatagacttcatggtggagagaaatcttacaaatgtaaggtctgtgacaaggcttttgcgtggaattcacacctggtaagacatactagaattcatagtggaggaaaaccttacaagtgtaatgaatgtgggaagacctttggtcaaaattcagatcttctaattcataagtcaattcatactggagagcaaccttacaaatatgaagaatgtgaaaaggttttcagttgtggatcaacccttgagacacataagataattcacaccggagagaaaccatacaaatgtaaggtttgtgacaaggcttttgcgtgtcattcctatctggcaaaacatactagaattcatagtggagagaaaccttacaagtgtaatgagtgcagcaagaccttccgtctgaggtcataccttgcaagccatcgcagagttcatagtggtgagaaaccttacaagtgtaatgagtgcagcaagaccttcagtcagaggtcataccttcattgccatcgtagacttcatagtggtgagaaaccttacaagtgtaatgagtgtggcaagaccttcagtcacaagccatcccttgttcaccatcgtagacttcatactggagagaaatcttacaaatgtacggtttgtgacaaggctttcgtgcgtaattcatacctggcaagacataccagaattcacactgcagagaaaccttacaagtgtaatgaatgtgggaaggcttttaatcaacaatcacaactttcacttcatcatagaattcatgctggggagaaactttacaaatgtgaaacatgtgacaaagttttcagtcgcaaatcacaccttaaaagacataggagaattcatcctggaaagaaaccatacaaatgtaaggtttgtgacaagacttttgggagtgattcacacctgaaacaacatactggacttcacactggagagaaaccttacaagtgtaatgagtgtggcaaagcctttagcaagcagtcaacacttattcaccatcaggcagttcatggtgtagggaaacttgactaatgtaatgattgtcacaaagtcttcagtaacgctacaaccattgcaaatcattggagaatctataatgaataaagatctaacaagtgtaataaa

SEQ ID NO: 248 - DNA, 6489 bp, Homo sapiens
  misc feature (1)..(6489): ZNRF3
gcacagaagtttgctgcatcactggtgagctggggagtgtcctgtgtggtgtccacttaatcttactaggaaggatcccctcatttcaacaagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgttaaaaaaaaaaaaaaaaaaaa

SEQ ID NO: 249 - DNA, 2095 bp, Homo sapiens
  misc feature (1)..(2095): NKX2-2
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaaaaaaaaaaaa

SEQ ID NO: 250 - DNA, 1857 bp, Homo sapiens
  misc feature (1)..(1857): NKX2-8
ccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagttaaaaaaaaaaaaaaaaaaaaaaaaaaaaaaaaaaaaaaaaaaaaaaaaaaaaaaa

SEQ ID NO: 251 - DNA, 3024 bp, Homo sapiens
  misc feature (1)..(3024): NKX3-1
atgctcagggttccggagccgcggcccggggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgcttctggctacctgtttgaaggggagagagggaaaatcaagtggtattttccagcactttgtatgattttggatgagttgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagatttaaaaaaaaaaaaaaaaa

The invention claimed is:

1. A method for correcting abnormal operation of at least one cellular signaling pathway(s) in a subject suffering from cancer, comprising:
   measuring expression levels of at least three mRNA direct target genes of each of the at least one cellular signaling pathway(s) in a sample isolated from the subject;
   determining the activity of the cellular signaling pathway(s) based on the measured expression levels of the at least three mRNA direct target genes;
   calculating, using a processing circuit, activity of the cellular signaling pathway(s) in the sample by evaluating at least a portion of a probabilistic model of the cellular signaling pathway(s), the probabilistic model representing the cellular signaling pathway(s) for a set of inputs including at least the expression levels of the at least three mRNA direct target genes of the cellular signaling pathway(s);
   determining a level in the sample of at least one transcription factor (TF) element, the at least one TF element controlling transcription of the at least three mRNA direct target genes of the cellular signaling pathway(s), and the determining being based at least in part on conditional probabilities relating the at least one TF element and the expression levels of the at least three mRNA direct target genes of the cellular signaling pathway(s);
   determining the activity of the cellular signaling pathway(s) based on the determined level in the sample of the at least one TF element;
   determining that the cellular signaling pathway that is Hedgehog is operating abnormally in the subject based on the determined activity of the cellular signaling pathway(s), wherein the abnormal operation of the Hedgehog cellular signaling pathway is inactive; and
   selecting, based on the determined abnormal operation of the Hedgehog cellular signaling pathway(s), a specific treatment configured to remedy the determined abnormal operation of the Hedgehog pathway, wherein the selected specific treatment is an agonist of the Hedgehog cellular signaling pathway;

administering the selected Hedgehog cellular signaling pathway agonist treatment to the subject suffering from cancer;

wherein the cellular signaling pathway(s) comprise(s) a Wnt pathway, an ER pathway, an AR pathway and/or a Hedgehog pathway;

wherein the measuring the expression levels of the at least three mRNA direct target genes of the cellular signaling pathway(s) comprises:

measuring the expression levels of the at least three mRNA direct target genes of the Wnt pathway selected from target genes consisting of: KIAA1199, AXIN2, RNF43, TBX3, TDGF1, SOX9, ASCL2, IL8, SP5, ZNRF3, KLF6, CCND1, DEFA6, and FZD7, and/or measuring the expression levels of the at least three mRNA direct target genes of the ER pathway selected from target genes consisting of: CDH26, SGK3, PGR, GREB1, CA12, XBP1, CELSR2, WISP2, DSCAM, ERBB2, CTSD, TFF1, and NRIP1, and/or measuring the expression levels of the at least three mRNA direct target genes of the Hedgehog pathway selected from target genes of the Hedgehog pathway consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1, and/or measuring the expression levels of the at least three mRNA direct target genes of the AR pathway selected from target genes consisting of: KLK2, PMEPA1, TMPRSS2, NKX3-1, ABCC4, KLK3, FKBP5, ELL2, UGT2B15, DHCR24, PPAP2A, NDRG1, LRIG1, CREB3L4, LCP1, GUCY1A3, AR, and EAF2.

2. The method according to claim 1, wherein the determining comprises:

estimating the level in the sample of the subject of the at least one transcription factor (TF) element represented by a TF node of the probabilistic model, the TF element controlling transcription of the at least three mRNA direct target genes of the cellular signaling pathway(s), the estimating being based at least in part on conditional probabilities of the probabilistic model relating the TF node and nodes in the probabilistic model representing the at least three mRNA direct target genes of the cellular signaling pathway(s); and wherein the calculating by evaluating at least a portion of a probabilistic model is performed by using a Bayesian network comprising nodes representing information about the signaling pathway(s) and conditional probability relationships between connected nodes of the Bayesian network.

3. The method of claim 1, wherein determining the activity of the cellular signaling pathway(s) is further based on expression levels of at least one target gene of the Hedgehog pathway measured in the sample selected from the group comprising: BCL2, FOXA2, FOXF1, H19, HHIP, IL1R2, JAG2, JUP, MIF, MYLK, NKX2-2, NKX2-8, PITRM1, and TOM1.

4. The method of claim 1, further comprising at least one of the following activities:

diagnosing based on the determined activity of the cellular signaling pathway(s);

preparing a prognosis based on the determined activity of the cellular signaling pathway(s);

drug prescribing based on the determined activity of the cellular signaling pathway(s);

predicting drug efficacy based on the determined activity of the cellular signaling pathway(s);

predicting adverse effects based on the determined activity of the cellular signaling pathway(s);

monitoring of drug efficacy;

developing drugs;

developing assays;

researching pathways;

cancer staging;

enrolling the subject in a clinical trial based on the determined activity of the cellular signaling pathway(s);

selecting a subsequent test to be performed; and selecting companion diagnostics tests.

5. The method of claim 1, further comprising the step of providing the determined level in the sample of the at least one TF element to a clinical decision support system, and wherein the steps of: (1) determining that the Hedgehog cellular signaling pathway(s) is operating abnormally in the subject based on the determined activity of the cellular signaling pathway(s); and (2) selecting a treatment configured to remedy the determined abnormal operation of the Hedgehog cellular signaling pathway(s), is performed by the clinical decision support system.

6. A method for correcting abnormal operation of at least one cellular signaling pathway(s) in a subject suffering from cancer, comprising:

selecting, based on determined abnormal operation of at least one cellular signaling pathway(s), a specific treatment configured to remedy the determined abnormal operation of the at least one cellular signaling pathway(s), wherein the selected specific treatment is an agonist of the cellular signaling pathway that is Hedgehog, and wherein the abnormal operation of the at least one cellular signaling pathway(s) is determined by:

measuring expression levels of at least three mRNA direct target genes of each of the at least one cellular signaling pathway(s) in a sample isolated from the subject;

determining the activity of the cellular signaling pathway(s) based on the measured expression levels of the at least three mRNA direct target genes;

calculating, using a processing circuit, activity of the cellular signaling pathway(s) in the sample by evaluating at least a portion of a probabilistic model of the cellular signaling pathway(s), the probabilistic model representing the cellular signaling pathway(s) for a set of inputs including at least the expression levels of the at least three mRNA direct target genes of the cellular signaling pathway(s);

determining a level in the sample of at least one transcription factor (TF) element, the at least one TF element controlling transcription of the at least three mRNA direct target genes of the cellular signaling pathway(s), and the determining being based at least in part on conditional probabilities relating the at least one TF element and the expression levels of the at least three mRNA direct target genes of the cellular signaling pathway(s);

determining the activity of the cellular signaling pathway(s) based on the determined level in the sample of the at least one TF element;

determining that the Hedgehog cellular signaling pathway is operating abnormally in the subject based on the determined activity of the cellular signaling pathway(s), wherein the abnormal operation of the Hedgehog cellular signaling pathway is inactive; and
administering the selected Hedgehog cellular signaling pathway agonist to the subject suffering from cancer;
wherein the cellular signaling pathway(s) comprise(s) a Wnt pathway, an ER pathway, an AR pathway and/or a Hedgehog pathway;
wherein the measuring the expression levels of the at least three mRNA direct target genes of the cellular signaling pathway(s) comprises:
measuring the expression levels of the at least three mRNA direct target genes of the Wnt pathway selected from target genes consisting of: KIAA1199, AXIN2, RNF43, TBX3, TDGF1, SOX9, ASCL2, IL8, SP5, ZNRF3, KLF6, CCND1, DEFA6, and FZD7, and/or measuring the expression levels of the at least three mRNA direct target genes of the ER pathway selected from target genes consisting of: CDH26, SGK3, PGR, GREB1, CA12, XBP1, CELSR2, WISP2, DSCAM, ERBB2, CTSD, TFF1, and NRIP 1,
and/or
measuring the expression levels of the at least three mRNA direct target genes of the Hedgehog pathway selected from target genes of the Hedgehog pathway consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1,
and/or
measuring the expression levels of the at least three mRNA direct target genes of the AR pathway selected from target genes consisting of: KLK2, PMEPA1, TMPRSS2, NKX3-1, ABCC4, KLK3, FKBP5, ELL2, UGT2B15, DHCR24, PPAP2A, NDRG1, LRIG1, CREB3L4, LCP1, GUCY1A3, AR, and EAF2.

7. A method for correcting abnormal operation of a Hedgehog pathway in a subject suffering from cancer, comprising:
selecting a Hedgehog pathway agonist to treat the subject suffering from cancer based on determined abnormal operation of the Hedgehog pathway, wherein the abnormal operation of the Hedgehog pathway is determined by:
measuring expression levels of at least three mRNA direct target genes of each of the Hedgehog pathway genes in a sample isolated from the subject;
determining the activity of the Hedgehog pathway based on the measured expression levels of the at least three mRNA direct target genes;
calculating, using a processing circuit, activity of the Hedgehog pathway in the sample by evaluating at least a portion of a probabilistic model of the Hedgehog pathway, the probabilistic model representing the Hedgehog pathway for a set of inputs including at least the expression levels of the at least three mRNA direct target genes of the Hedgehog pathway;
determining a level in the sample of at least one transcription factor (TF) element, the at least one TF element controlling transcription of the at least three mRNA direct target genes of the Hedgehog pathway, and the determining being based at least in part on conditional probabilities relating the at least one TF element and the expression levels of the at least three mRNA direct target genes of the Hedgehog pathway;
determining the activity of the Hedgehog pathway based on the determined level in the sample of the at least one TF element;
determining that the Hedgehog pathway is operating abnormally in the subject based on the determined activity of the Hedgehog pathway, wherein the abnormal operation of the Hedgehog pathway is inactive; and
administering the selected Hedgehog pathway agonist to the subject suffering from cancer;
wherein the measuring the expression levels of the at least three mRNA direct target genes of the Hedgehog pathway comprises at least measuring the expression levels of the at least three mRNA direct target genes of the Hedgehog pathway selected from target genes of the Hedgehog pathway consisting of: GLI1, PTCH1, PTCH2, IGFBP6, SPP1, CCND2, FST, FOXL1, CFLAR, TSC22D1, RAB34, S100A9, S100A7, MYCN, FOXM1, GLI3, TCEA2, FYN, and CTSL1.

* * * * *